(12) United States Patent
Ma et al.

(10) Patent No.: US 10,169,530 B2
(45) Date of Patent: Jan. 1, 2019

(54) GENE FUSIONS AND ALTERNATIVELY SPLICED JUNCTIONS ASSOCIATED WITH BREAST CANCER

(71) Applicant: GENOMIC HEALTH, INC., Redwood City, CA (US)

(72) Inventors: Yan Ma, Burlingame, CA (US); Kunbin Qu, Palo Alto, CA (US); Mei-Lan Liu, San Mateo, CA (US); Ranjana Ambannavar, Cupertino, CA (US); James Stephans, Redwood City, CA (US)

(73) Assignee: Genomic Health, Inc., Redwood City, CA (US)

( * ) Notice: Subject to any disclaimer, the term of this patent is extended or adjusted under 35 U.S.C. 154(b) by 628 days.

(21) Appl. No.: 14/440,582

(22) PCT Filed: Nov. 4, 2013

(86) PCT No.: PCT/US2013/068236
§ 371 (c)(1),
(2) Date: May 4, 2015

(87) PCT Pub. No.: WO2014/071279
PCT Pub. Date: May 8, 2014

(65) Prior Publication Data
US 2015/0302143 A1   Oct. 22, 2015

Related U.S. Application Data

(60) Provisional application No. 61/766,561, filed on Feb. 19, 2013, provisional application No. 61/722,634, filed on Nov. 5, 2012.

(51) Int. Cl.
*G06F 19/18* (2011.01)
*C12Q 1/6886* (2018.01)
*G06F 19/22* (2011.01)
*G16H 50/20* (2018.01)

(52) U.S. Cl.
CPC ............ *G06F 19/18* (2013.01); *C12Q 1/6886* (2013.01); *G06F 19/22* (2013.01); *G16H 50/20* (2018.01); *C12Q 2600/112* (2013.01); *C12Q 2600/118* (2013.01); *C12Q 2600/156* (2013.01); *C12Q 2600/16* (2013.01)

(58) Field of Classification Search
None
See application file for complete search history.

(56) References Cited

U.S. PATENT DOCUMENTS

| | | |
|---|---|---|
| 6,849,400 B1 | 2/2005 | Harvey et al. |
| 2004/0115686 A1 | 6/2004 | Dolginow et al. |
| 2005/0214823 A1 | 9/2005 | Blume et al. |

OTHER PUBLICATIONS

Levin et al., "Targeted Next-Generation Sequencing of a Cancer Transcriptome Enhances Detection of Sequence Variants and Novel Fusion Transcripts", Genome Biology, vol. 10, 2009, 8 pages.
International Search Report and Written Opinion dated Apr. 18, 2014, for International Patent Application No. PCT/US2013/068236, filed Nov. 4, 2013.

*Primary Examiner* — Joseph Woitach
(74) *Attorney, Agent, or Firm* — Genomic Health/McNeill Baur PLLC

(57) ABSTRACT

The present invention relates to gene fusions and alternative spliced junctions associated with breast cancer. The present invention also relates to novel methods of identifying gene fusions and alternative spliced junctions in RNA sequencing data. The present invention further relates to predicting prognosis of a breast cancer patient based on the number of gene fusion events.

6 Claims, 406 Drawing Sheets
Specification includes a Sequence Listing.

FIGURE 3.1A

```
                                       ------GGCCTCGGAAAAGCTGGCACAGTGCCCCCT|GAAATGTTTGACATCATCC------
                                             SEQUENCER02:107:A815WRABXX:3:1201:13692:128249
                                       ----CGGAAAAGCTGGCACAGTGCCCCCCT|GAAATGTTTGACATCATCCTGGAT-----
                                             SEQUENCER02:107:A815WRABXX:3:1204:4263:195963
                                       -----TGGCACAGTGCCCCCCT|GAAATGTTTGACATCATCCTGGATGAGAACCAA----
                                             SEQUENCER02:107:A815WRABXX:3:1206:18006:58412
                                       ------GGCACAGTGCCCCCCT|GAAATGTTTGA CATCATCCTGGATGAGAACCAAT----
                                             SEQUENCER02:107:A815WRABXX:3:1101:4105:31132
                                       ------GGCACAGTGCCCCCCT|GAAATGTTTGACATCATCCTGGATGAGAACCAAT----
                                             SEQUENCER02:107:A815WRABXX:3:1105:7671:75181
                                       ------GGCACAGTGCCCCCT|GAAATGTTTGACATCATCCTGGATGAGAACCAAT-----
                                             SEQUENCER02:107:A815WRABXX:3:1205:2672:186723
                                       --------GGCACAGTGCCCCCCT|GAAATGTTTGACATCATCCTGGATGAGAACCAA----
                                             SEQUENCER02:107:A815WRABXX:3:1206:19985:88068
                                       ---------GGCACAGTGCCCCCCT|GAAATGTTTGACATCATCCTGGATGAGAACCAAT---
                                             SEQUENCER02:107:A815WRABXX:3:1208:12632:176832
##############################################################
#######
107TTAGGC_3    -chr17:37840850_-chr17:37333788     PGAP3_CACNB1    donor_genomic_template
*******
TCGTGCCAGCCTCCTCCCCCATGTACCACACCTGTGTGGCCTTCGCCTGG|GTAGGTAACCTAGCAGGACTCCTGCTGTCTCCTCTTAT
CTAGGAAGGTGG     junction_-chr17_37840850_NM_033419
                                       --------GTGTGGCCTTCGCCTGG|GTAGGTAACCTAGCAGGACTCCTGCTGTCTCCT----
                                             SEQUENCER02:107:A815WRABXX:3:1206:16191:40491
                                       --------GTGTGGCCTTCGCCTGG|GTAGGTAACCTAGCAGGACTCCTGCTGTTTCCT----
                                             SEQUENCER02:107:A815WRABXX:3:1208:6993:135993
TCGCCTGG|GTAGGTAACCTAGCAGGACTCCTGCTGTCTCCTCTTATCTA------
     SEQUENCER02:107:A815WRABXX:3:1103:10511:163332
TCGCCTGG|GTAGGTAACCTAGCAGGACTCCTGCTGTCTCCTCTTATCTA------
     SEQUENCER02:107:A815WRABXX:3:1205:2755:141678
```

FIGURE 3.1B

```
################################################################################
###########
107TTAGGC_3    -chr17:37840850_-chr17:37333788    PGAP3_CACNB1
           acceptor_genomic_template
********************************************************************************
***********
TGGCCATGCCCCACTCATCCCAGCCTGCCCCCTAACCCCGCCTTCACAG|GAAATGTTTGACATCATCCTGGATGAGAACCAATTGGA
GGATGCCTGCGA    junction_-chr17_37333788_NM_000723
################################################################################
###########
```

FIGURE 3.1C

3.2. SEMA4C_RBMS1

```
107TTAGGC_4    -chr2:97527316_-chr2:161131275    SEMA4C_RBMS1    fusion_template
********************************************************************************
*********
GATGACCTCGGACACTTCAGGCATCTGCAACCTCCGTGGCAGTAAGAAAG|ATGTACAGAAAGGTGTTCTTACATGAAGAAGGGTGTGA
AGGCTGAACAAT     junction_-chr2_97527316_-chr2_161131275_NM_017789_NM_002897
*********************************************************************************
         TTCAGGCATCTGCAACCTCCGTGGCAGTAAGAAAG|ATGTACAGAAAGGTG--------- SEQUENCER02:107:A815WRABXX:4:1203:15143:156224
         TTCAGGCATCTGCAACCTCCGTGGCAGTAAGAAAG|ATGTACAGAAAGGTG--------- SEQUENCER02:107:A815WRABXX:4:2102:13668:165581
          CAGGCATCTGCAACCTCCGTGGCAGTAAGAAAG|ATGTACAGAAAGGTGTT-------- SEQUENCER02:107:A815WRABXX:4:1201:9777:149072
             CCGTGGCAGTAAGAAAG|ATGTACAGAAAGGTGTTTTTACATGAAGAAGGG---- SEQUENCER02:107:A815WRABXX:4:1201:18756:108724
             CCGTGGCAGTAAGAAAG|ATGTACAGAAAGGTGTTCTTACATGAAGAAGG----- SEQUENCER02:107:A815WRABXX:4:2203:12773:176372
             CCGTGGCAGTAAGAAAG|ATGTACAGAAAGGTGTTCTTACATGAAGAAGG----- SEQUENCER02:107:A815WRABXX:4:2205:13934:14889
             --GTGGCAGTAAGAAAG|ATGTACAGAAAGGTGTTCTTACATGAAGAAGGG---- SEQUENCER02:107:A815WRABXX:4:1107:3116:73616
```

```
                                         -------CCGTGGCAGTAAGAAAG|GTGAGCTTTTTCATTCCCGTCGCATCGGGCTGA------
               SEQUENCER02:107:A815WRABXX:4:1208:16277:61844
                                         -------CCGTGGCAGTAAGAAAG|GTGAGCTTTTTCATTCCCGTCGCATCGGGCTGA------
               SEQUENCER02:107:A815WRABXX:4:2104:15606:58184
                                         -------CCGTGGCAGTAAGAAAG|GTGAGCTTTTTCATTCCCGTCGCATCGGGCTGA------
               SEQUENCER02:107:A815WRABXX:4:2208:7112:114021
                                         -------TGGCAGTAAGAAAG|GTGAGCTTTTTCATTCCCGTCGCATCGGACTGAGCC--
               SEQUENCER02:107:A815WRABXX:4:2101:15214:172392
AAGAAAG|GTGAGCTTTTTCATTCCCGTCGCCATCGGGCTGAGCCCTGGACC-------
               SEQUENCER02:107:A815WRABXX:4:1102:14607:99592
AAGAAAG|GTGAGCTTTTTCATTCCCGTCGCCATCGGGCTGAGCCCTGGACC-------
               SEQUENCER02:107:A815WRABXX:4:2107:209969:194238
##########################################################    SEMA4C_RBMS1
107TTAGGC_4    -chr2:97527316_-chr2:161131275
    acceptor genomic template
**********************************************************************************
GTTTCACACCAAATCTACAAAAGCATTTGTCTTTTATTTTCTCTTCCAG|ATGTACAGAAAGGTGTTCTTACATGAAGAAGGGTGTGA
AGGCTGAACAAT      junction_-chr2_161131275_NM_002897
################################################################################
################

3.3.   CLTB_CDHR2
107TTAGGC_4    -chr5:175837258_+chr5:175995679     CLTB_CDHR2     fusion_template
**********************************************************************************
GGGCTGGTTCTGAGGACATGGGACCACAGTCAATGGAGATGTGTTTCAG|GTGCCCAGGCCTTCTGGTTGGTAGCGGAAGACCAGGAC
AATGACCCTCTG    junction_-chr5_175837258_+chr5_175995679_NM_001834_NM_017675
----------------GTGGCAGTAAGAAAG|ATGTACAGAAAGGTGTTCTTACATGAAGAAGGG-----
               SEQUENCER02:107:A815WRABXX:4:1108:1346:5150
```

```
------------------------------------GTGGCAGTAAGAAAAG|ATGTACAGAAAGTGTTCTTACATGAAGAAGGG----
----------SEQUENCER02:107:A815WRABXX:4:1207:5487:193582       SEMA4C_RBMS1
################################################################################
107TTAGGC_4    -chr2:97527316_-chr2:161131275       donor_template
****************************************************************************
GATGACCTCGGACACTTCAGGCATCTGCAACCTCCGTGGCAGTAAGAAAG|TCAGGCCCCACTCCCAAAAACATCACGGTGGTGGCGGGC
ACAGACCTGGTG   junction_-chr2_97527316_-chr2_97527192_NM_017789
--------------------CCGTGGCAGTAAGAAAG|TCAGGCCCCACTCCCAAAAACATCACGGTGG----
----------SEQUENCER02:107:A815WRABXX:4:1204:4532:154909       SEMA4C_RBMS1
################################################################################
107TTAGGC_4    -chr2:97527316_-chr2:161131275       acceptor_template
****************************************************************************
GTCTAATGACCATTCTCCATATACCTTTCAACCTAATAAGTAACTGTGAG|ATGTACAGAAAGTGTTCTTACATGAAGAAGGGTGTGA
AGGCTGAACAAT   junction_-chr2_161132141_-chr2_161131275_NM_002897
################################################################################
107TTAGGC_4    -chr2:97527316_-chr2:161131275       donor_genomic_template
****************************************************************************
GATGACCTCGGACACTTCAGGCATCTGCAACCTCCGTGGCAGTAAGAAAG|GTGAGCTTTTTCATTCCCGTGCATCGGGCTGAGCCCT
GGACCAGAGCTG   junction_-chr2_97527316_NM_017789
--------------------CCGTGGCAGTAAGAAAG|GTGAGCTTTTTCATTCCCGTGCATCGGGCTGA----
----------SEQUENCER02:107:A815WRABXX:4:1101:18531:134860
--------------------CCGTGGCAGTAAGAAAG|GTGAGCTTTTTCATTCCCGTGCATCGGGCTGA----
----------SEQUENCER02:107:A815WRABXX:4:1202:15591:141778
--------------------CCGTGGCAGTAAGAAAG|GTGAGCTTTTTCATTCCCGTGCATCGGGCTGA----
----------SEQUENCER02:107:A815WRABXX:4:1206:4549:139907
################################################################################
```

FIGURE 3.3B 3.4.    UCK2_TMCO1

```
107TTAGGC_6    +chr1:165797169_-chr1:165697358         UCK2_TMCO1       fusion_template
*********************************************************************************
GCGGCGAGCCCTTCCTTATAGGCGTCAGCGGGGAACAGCTAGCGGCAAG|AACATTCAGAAGATTCTCGGCCTTGCCCCTTCACGAGC
CGCCACCAAGCA      junction_+chr1_165797169_-chr1_165697358_NM_012474_NM_019026
           ---CAGCGGGGAACAGCTAGCGGCAAG|AACATTCAGAAGATTCTCGGCCTTG-------
          SEQUENCER02:107:A815WRABXX:6:1205:10389:156362
          --CGGGGAACAGCTAGCGGCAAG|AACATTCAGAAGATTCTCGGCCTTGCC-----
          SEQUENCER02:107:A815WRABXX:6:2208:2091:160542
          ---GGGGAACAGCTAGCGGCAAG|AACATTCAGAAGATTCTCGGCCTTGCCC----
          SEQUENCER02:107:A815WRABXX:6:1105:10179:1113507
          ---GGGGAACAGCTAGCGGCAAG|AACATTCAGAAGATTCTCGGCCTTGCCC----
          SEQUENCER02:107:A815WRABXX:6:2208:18388:3150

AGCGGCAAG|AACATTCAGAAGATTCTCGGCCTTGCCCCTTCACGAGCCGC-------
          SEQUENCER02:107:A815WRABXX:6:2206:17715:191298
###############################################################################

107TTAGGC_6    +chr1:165797169_-chr1:165697358         UCK2_TMCO1       donor_template
*********************************************************************************
GCGGCGAGCCCTTCCTTATAGGCGTCAGCGGGGAACAGCTAGCGGCAAG|TCTTCCGTGTGTGCAGCTCCTGGGCA
GAATGAGGTGGA      junction_+chr1_165797169_-chr1_165859441_NM_012474
          ---CAGCGGGGAACAGCTAGCGGCAAG|TCTTCCGTGTGTGCTAAGATCGTGC-------
          SEQUENCER02:107:A815WRABXX:6:1108:17130:94264
          --GCGGGGAACAGCTAGCGGCAAG|TCTTCCGTGTGTGCTAAGATCGTGCAG-----
          SEQUENCER02:107:A815WRABXX:6:2104:17895:76272
          ---CGGGGAACAGCTAGCGGCAAG|TCTTCCGTGTGTGCTAAGATCGTGCAGC----
          SEQUENCER02:107:A815WRABXX:6:1103:14194:106071
          ---GGGGAACAGCTAGCGGCAAG|TCTTCCGTGTGTGCTAAGATCGTGCAGC----
```

3.5. GBAS_PCLO

```
107TTAGGC_6      +chr7:56032394_-chr7:82595803_GBAS_PCLO_fusion_template
****************************************************************************
*************
GGCGGCCTCCTGCAGCGGGCGGCCCCTGCAGCCTCCTGCCAGGCTCCG|ATTCAAGAATGGCTTTGTTTAAATTGCCAAACCCAGAG
AGCAATATCAGG    junction +chr7_56032394_-chr7_82595803_NM_001483_NM_014510
            --------TGCAGCCTCCTGCCAGGCTCCG|ATTCAAGAATGGCTTTGTTTAAATTG---------
            SEQUENCER02:107:A815WRABXX:6:2203:5106:169305
            --------TGCAGCCTCCTGCCAGGCTCCG|ATTCAAGAATGGCTTTGTTTAAATTG---------
            SEQUENCER02:107:A815WRABXX:6:2204:5013:133014
            --------TGCAGCCTCCTGCCAGGCTCCG|ATTCAAGAATGGCTTTGTTTAAATTG---------
            SEQUENCER02:107:A815WRABXX:6:2205:19022:189202
################################################################################
############
107TTAGGC_6      +chr7:56032394_-chr7:82595803_GBAS_PCLO_donor_template
****************************************************************************
*************
GGCGGCCTCCTGCAGCGGGCGGCCCCTGCAGCCTCCTGCCAGGCTCCG|GACATGGACATCTTCCAGCAACAGATCTCGAGAAGACA
GCTGGCTAAAAT    junction +chr7_56045819_NM_001483
         -------GGCCCCCTGCAGCCTCCTGCCAGGCTCCG|GACATGGACATCTTCCAGCA----------
         SEQUENCER02:107:A815WRABXX:6:1206:21044:146750
         -------GGCCCCCTGCAGCCTCCTGCCAGGCTCCG|GACATGGACATCTTCCAGCA----------
         SEQUENCER02:107:A815WRABXX:6:2108:6073:172540
         -------GGCCCCCTGCAGCCTCCTGCCAGGCTCCG|GACATGGACATCTTCCAGCA----------
         SEQUENCER02:107:A815WRABXX:6:2205:13586:31844
         ---------CCTGCCAGGCTCCG|GACATGGACATCTTCCAGCAACAGATCTCGAGAAG-------
         SEQUENCER02:107:A815WRABXX:6:1107:11585:187600

GCCCAGGCTCCG|GACATGGACATCTTCCAGCAACAGATCTCGAGAAGACA---------
          SEQUENCER02:107:A815WRABXX:6:1105:11553:131691
```

FIGURE 3.5A

```
|----------------------------------------------------|
 GCCCAGGCTCCG|GACATGGACATCTTCCAGCAACAGATCTCGAGAAGACA----|
              SEQUENCER02:107:A815WRABXX:6:1106:14069:35259
|-----------|----------------------------------------|
 GCCCAGGCTCCG|GACATGGACATCTTCCAGCAACAGATCTCGAGAAGACA----|
              SEQUENCER02:107:A815WRABXX:6:1107:4954:152133
|-----------|----------------------------------------|
 GCCCAGGCTCCG|GACATGGACATCTTCCAGCAACAGATCTCGAGAAGACA----|
              SEQUENCER02:107:A815WRABXX:6:1203:3791:17596
|-----------|----------------------------------------|
 GCCCAGGCTCCG|GACATGGACATCTTCCAGCAACAGATCTCGAGAAGACA----|
              SEQUENCER02:107:A815WRABXX:6:1207:3334:81907
|-----------|----------------------------------------|
 GCCCAGGCTCCG|GACATGGACATCTTCCAGCAACAGATCTCGAGAAGACA----|
              SEQUENCER02:107:A815WRABXX:6:1208:7454:41848
|-----------|----------------------------------------|
 GCCCAGGCTCCG|GACATGGACATCTTCCAGCAACAGATCTCGAGAAGACA----|
              SEQUENCER02:107:A815WRABXX:6:2107:2582:197108
|-----------|----------------------------------------|
 GCCCAGGCTCCG|GACATGGACATCTTCCAGCAACAGATCTCGAGAAGACA----|
              SEQUENCER02:107:A815WRABXX:6:2201:2186:176896
|-----------|----------------------------------------|
 GCCCAGGCTCCG|GACATGGACATCTTCCAGCAACAGATCTCGAGAAGACA----|
              SEQUENCER02:107:A815WRABXX:6:2203:1837:179181
|-----------|----------------------------------------|
 GCCCAGGCTCCG|GACATGGACATCTTCCAGCAACAGATCTCGAGAAGACA----|
              SEQUENCER02:107:A815WRABXX:6:2203:8789:85943
|-----------|----------------------------------------|
 GCCCAGGCTCCG|GACATGGACATCTTCCAGCAACAGATCTCGAGAAGACA----|
              SEQUENCER02:107:A815WRABXX:6:2206:2085:186378
|-----------|----------------------------------------|
 GCCCAGGCTCCG|GACATGGACATCTTCCAGCAACAGACCTCGAGAAGACA----|
              SEQUENCER02:107:A815WRABXX:6:2207:9877:139556
|-----------|----------------------------------------|
```

FIGURE 3.5B

```
GCCCAGGCTCCG|GACATGGACATCTTCCAGCAACAGATCTCGAGAAGACA---------
      SEQUENCER02:107:A815WRABXX:6:2208:7332:106220
---------------
CAGGCTCCG|GACATGGACATCTTCCAGCAACAGATCTCGAGAAGACAGCT---------
      SEQUENCER02:107:A815WRABXX:6:1106:16854:185159
#####################################################

107TTAGGC_6    +chr7:56032394_-chr7:82595803 GBAS_PCLO acceptor_template
************************************************************
*********
ATCAAGTGTGTAATCTCTGTGGATTTAACCCTACACCACATTGACTGAG|ATTCAAGAATGGCTTTGTTTAAATTGCCAAACCCAGAG
AGCAATATCAGG   junction -chr7_82763566_-chr7_82595803_NM_014510
#####################################################

107TTAGGC_6    +chr7:56032394_-chr7:82595803 GBAS_PCLO donor genomic_template
***********
GGCGGCCTCCTGCAGCGGCGCCCCCTGCAGCCTCCTGCCCAGGCTCCG|GTGAGCAGCGCGCCCTTCCCGGGAGTGCCGGGAGG
GGCCGCCGCGAG   junction +chr7_56032394_NM_001483
#####################################################

107TTAGGC_6    +chr7:56032394_-chr7:82595803 GBAS_PCLO acceptor_genomic_template
************************************************************
*********
AGATACATTATAATACATTCAATCTGTTCATTGTAATTTTTTCCCACAG|ATTCAAGAATGGCTTTGTTTAAATTGCCAAACCCAGAG
AGCAATATCAGG   junction -chr7_82595803_NM_014510
#####################################################

FIGURE 3.5C 3.6. ARNT2_MESDC2
108GCCAAT_3    +chr15:807503017_-chr15:81274523  ARNT2_MESDC2  fusion_template

```
108GCCAAT_4                    +chr17:5250220_+chr17:115532734         RABEP1_DNAH9    fusion_template
********************************************************************************************************
ATCTGTTCTACAGGAAGATGCTGAGAAACTGCGGAAAGAATTGCATGAAG|GGTCTTCTGAAGACGGCCCTGGATTTCCACAAACTGGG
AAAGGTGGAGTT    junction_+chr17_5250220_+chr17_115532734_NM_004703_NM_001372
--------------------GCGGAAAGAATTGCATGAAG|GGTCTTCTGAAGACGGCCCTGGATTTCCAC-----------
        SEQUENCER02:108:A81685ABXX:4:1108:15190:126526-------------------
AATTGCATGAAG|GGTCTTCTGAAGACGGCCCTGGATTTCCACAAACTGGG-----------
################################################################################
################

108GCCAAT_4                    +chr17:5250220_+chr17:115532734         RABEP1_DNAH9    donor_template
*********************************************************************************************************
ATCTGTTCTACAGGAAGATGCTGAGAAACTGCGGAAAGAATTGCATGAAG|TTTGCCATCTCTTGGAGCAAGAGCGACAACAACACAAC
CAGTTAAAACAT    junction_+chr17_5250220_+chr17_115532734_NM_5253746_NM_004703
--------------------GAGAAACTGCGGAAAGAATTGCATGAAG|TTTGCCATCTCTTGGAGCAAGA-------
        SEQUENCER02:108:A81685ABXX:4:1106:11633:43521
--------------------GAGAAACTGCGGAAAGAATTGCATGAAG|TTTGCCATCTCTTGGAGCAAGA-------
        SEQUENCER02:108:A81685ABXX:4:1107:1992:178779
--------------------GAGAAACTGCGGAAAGAATTGCATGAAG|TTTGCCATCTCTTGGAGCAAGA-------
        SEQUENCER02:108:A81685ABXX:4:1207:12193:36615
--------------------GAGAAACTGCGGAAAGAATTGCATGAAG|TTTGCCATCTCTTGGAGCAAGA-------
        SEQUENCER02:108:A81685ABXX:4:2204:7457:114907
--------------------GCGGAAAGAATTGCATGAAG|TTTGCCATCTCTTGGAGCAAGAGCGACAAC-------
        SEQUENCER02:108:A81685ABXX:4:1101:13610:7844
--------------------GCGGAAAGAATTGCATGAAG|TTTGCCATCTCTTGGAGCAAGAGCGACAAC-------
        SEQUENCER02:108:A81685ABXX:4:1203:14140:74436
--------------------GCGGAAAGAATTGCATGAAG|TTTGCCATCTCTTGGAGCAAGAGCGATAAC-------
        SEQUENCER02:108:A81685ABXX:4:1204:13112:87609
```

```
------------------------------------------------------------GCGGAAAGAAGAATTGCATGAAG|GTAAATATACTGTATATTTTATCTTTGTC------------
######################################################                        ********************************############
108GCCAAT_4    +chr17:5250220_+chr17:115532734                                      RABEP1_DNAH9
                acceptor_genomic_template
*****************************************************************************************************************#############
CGATAGTTGCTGCTGAGAATGATTTAACTTTTTTGTGAATTGTCCCATAG|GGTCTTCTGAAGACGGCCCTGGATTCCACAAACTGGG
AAAGGTGGAGTT     junction_+chr17_115532734_NM_001372
------------GATTTAACTTTTTTGTGAATTGTCCCATAG|GGTCTTCTGAAGACGGCC--------------------
                SEQUENCER02:108:A81685ABXX:4:2107:21092:98930
######                        *****************************************##########################################
```

FIGURE 3.7C

```
3.8
108GCCAAT_5    +chr6:152129499_+chr6:151785588                                      ESR1_C6orf211_fusion_template
****************************************************************************************************************
GAGCCCAGCGGCTACACGGTGCGCGAGGCCGGCCCCGGCATTCTACAG|TCCACCAATCGATTACTTTGATGTATTTAAAGAATCAA
AAGAGCAAAATT   junction_+chr6_152129499_+chr6_151785588_NM_000125_NM_024573
                                                -CGCCGGCATTCTACAG|TCCACCAATCGATTACTTTGATGTATTTAAAGAA------
                SEQUENCER02:108:A81685ABXX:5:1204:6360:177171
                                                -CGCCGGCATTCTACAG|TCCACCAATCGATTACTTTGATGTATTTAAAGAA------
                SEQUENCER02:108:A81685ABXX:5:2102:10140:132618
                                                -CGCCGGCATTCTACAG|TCCACCAATCGATTACTTTGATGTATTTAAAGAA------
                SEQUENCER02:108:A81685ABXX:5:2102:17642:71617
                                                -CGCCGGCATTCTACAG|TCCACCAATCGATTACTTTGATGTATTTAAAGAA------
                SEQUENCER02:108:A81685ABXX:5:2107:5086:39618
######                                    *********************************************************##############
108GCCAAT_5    +chr6:152129499_+chr6:151785588                                      ESR1_C6orf211_donor_template
```

FIGURE 3.8A

```
************************************************************************************
************
GAGCCCAGGCGGCTACACGGTGCGCGAGGCCGGCCCGCCGGCATTCTACAG|GCCAAATTCAGATAATCGACGCCAGGTGGCAGAGAAA
GATTGGCCAGTA    junction_+chr6_152129499_+chr6_152163732_NM_000125
         ----CGGTGCGCGAGGCCGGCCCGCCGGCATTCTACAG|GCCAAATTCAGATAAT------
               SEQUENCER02:108:A81685ABXX:5:1104:16960:83586
         ----CGGTGCGCGAGGCCGGCCCGCCGGCATTCTACAG|GCCAAATTCAGATAA-------
               SEQUENCER02:108:A81685ABXX:5:1208:11182:33161
         ------GTGCGCGAGGCCGGCCCGCCGGCATTCTACAG|GCCAAATTCAGATAATC-----
               SEQUENCER02:108:A81685ABXX:5:1104:6925:197032
         ------GTGCGCGAGGCCGGCCCGCCGGCATTCTACAG|GCCAAATTCAGATAATC-----
               SEQUENCER02:108:A81685ABXX:5:1104:7327:77375
         ------GTGCGCGAGGCCGGCCCGCCGGCATTCTACAG|GCCAAATTCAGATAATC-----
               SEQUENCER02:108:A81685ABXX:5:1107:10351:183094
         ------GTGCGCGAGGCCGGCCCGCCGGCATTCTACAG|GCCAAATTCAGATAATC-----
               SEQUENCER02:108:A81685ABXX:5:2102:7941:111231
         -------GTGCGCGAGGCCGGCCCGCCGGCATTCTACAG|GCCAAATTCAGATAATC----
               SEQUENCER02:108:A81685ABXX:5:2108:18714:134931
         -------GTGCGCGAGGCCGGCCCGTCGGCATTCTACAG|GCCAAATTCAGATAATCG---
               SEQUENCER02:108:A81685ABXX:5:1208:18281:62369
         --------TGCGCGAGGCCGGCCCGCCGGCATTCTACAG|GCCAAATTCAGATAATCG---
               SEQUENCER02:108:A81685ABXX:5:1208:18431:166075
         --------TGCGCGAGGCCGGCCCGCCGGCATTCTACAG|GCCAAATTCAGATAAT-----
               SEQUENCER02:108:A81685ABXX:5:2103:16229:124384
         ----------GCGCGAGGCCCGCCGGCATTCTACAG|GCCAAGTTCAGATAATCGAC----
               SEQUENCER02:108:A81685ABXX:5:2204:20744:2585
         ------------GCGAGGCCCGCCGGCATTCTACAG|GCCAAGTTCAGATAATCGAC----
               SEQUENCER02:108:A81685ABXX:5:1203:3152:105465
         -------------CGAGGCCCGCCGGCATTCTACAG|GCCAAATTCAGATAATCGAC----
               SEQUENCER02:108:A81685ABXX:5:1204:12913:110176
         -------------CGAGGCCCACCGGCATTCTACAG|GCCAAGTTCAGATAATCGAC----
               SEQUENCER02:108:A81685ABXX:5:1204:1603:23312
```

FIGURE 3.8B

```
------GCGCGAGGCCGGCCCCGGCATTCTACAG|GCCAAATTCAGATAATCGAC---------------
SEQUENCER02:108:A81685ABXX:5:1204:18129:162223
------GCGCGAGGCCGGCCCGCCGCATTCTACAG|GCCAAATTCAGATAATCGAC---------------
SEQUENCER02:108:A81685ABXX:5:2105:8723:100853
------GCGCGAGGCCGGCCCGCCGCATGCTACAG|GCCAAATTCAGATAATCGAC---------------
SEQUENCER02:108:A81685ABXX:5:2107:3956:40782
------GCGCGAGGCCGGCCCGCCGCATTCTACAG|GCCAAATTCAGATAATCGAC---------------
SEQUENCER02:108:A81685ABXX:5:2108:1386:180397
------GCGCGAGGCCGGCCCGCCGCATTCTACAG|GCCAAATTCAGATAATCGAC---------------
SEQUENCER02:108:A81685ABXX:5:2108:5604:110235
------GCGCGAGGCCGGCCACCGCATTCTACAG|GCCAAATTCAGATAATCGAC---------------
SEQUENCER02:108:A81685ABXX:5:2201:20618:115555
------GCGCGAGGCCGGCCACCGCATTCTACAG|GCCAAATTCAGATAATCGAC---------------
SEQUENCER02:108:A81685ABXX:5:2205:15015:19466
------GCGCGAGGCCGGCCCGCCGTCGGCATTCTACAG|GCCAAATTCAGATAATCGAC---------------
SEQUENCER02:108:A81685ABXX:5:2208:7242:149510
------CGCGAGGCCGGCCCGCCGTCGGCATTCTACAG|GCCAAATTCAGATAATCGACG-----------
SEQUENCER02:108:A81685ABXX:5:2106:7450:106750
------GCCCGCCGGCGTTCTACAG|GCCAAATTCAGATAATCGACGCCAGGGTGGC-------
SEQUENCER02:108:A81685ABXX:5:2203:9161:20820
------CCGCTGGCATTCTACAG|GCCAAATTCAGATAATCGACGCCAGGGTGGCAG------
SEQUENCER02:108:A81685ABXX:5:1204:12201:68865
------GCCGGCATTCTACAG|GCCAAATTCAGATAATCGACGCCAGGGTGGCAGAG----
SEQUENCER02:108:A81685ABXX:5:2103:16779:99910
###############
108GCCAAT_5   +chr6:152129499_+chr6:151785588    ESR1_C6orf211   acceptor_template
*************************************************
TTGGTAGAATGTTACATGTATCGAAGAATTCATGAAGCAATTATCCAGAG|TCCACCAATCGATTACTTTGATGTATTTAAAGAATCAA
AAGAGCAAAATT  junction  +chr6_151779707_+chr6_151785588_NM_024573
```

FIGURE 3.8C

```
108GCCAAT_5    +chr6:152129499 +chr6:151785588    ESR1_C6orf211_donor_genomic_template
***********************************************************************************
GAGCCCAGCGGCTACACGGTGCGCGAGGCCGGCCGGCCATTCTACAG|GTACCCGGCCCGCGCCCCGCCCGTCGGGTGGCCGCC
GCCCGGCAGGAG   junction +chr6_152129499_NM_000125
#################################################################################
108GCCAAT_5    +chr6:152129499 +chr6:151785588    ESR1_C6orf211
***********************************************************************************
           acceptor_genomic_template
                                     ***********************************************
ATCCAAATGTACAAACTAAAAATGTTTCACTTTGTTTTTCTCCTACTTTAG|TCCACCAATCGATTACTTTGATGTATTTAAAGAATCAA
AAGAGCAAAATT   junction +chr6_151785588_NM_024573
#################################################################################
```

FIGURE 3.8D

```
3.9 ESR1_AKAP12
108GCCAAT_5    +chr6:152265643 +chr6:151669846    ESR1_AKAP12    fusion_template
***********************************************************************************
GGCAGACAGGGAGCTGGTTCACATGATCAACTGGGCGAAGAGAGGTGCCAG|TTGGACAGAGAGACTCTGAAGATGTGAGCAAAAGAGAC
TCCGATAAAGAG   junction +chr6_152265643 +chr6_151669846_NM_000125_NM_005100
***********************************************************************************
         -----GGGAGCTGGTTCACATGATCAACTGGGCGAAGAGAGGTGCCAG|TTGGACAG-----------------
                 SEQUENCER02:108:A81685ABXX:5:1108:1395:98938
         -----GGGAGCTGGTTCACATGATCAACTGGGCGAAGAGAGGTGCCAG|TTGGACA------------------
                 SEQUENCER02:108:A81685ABXX:5:1108:6338:154271
         -----GGGAGCTGGTTCACATGATCAACTGGGCGAAGAGAGGTGCCAG|TTGGACAG-----------------
                 SEQUENCER02:108:A81685ABXX:5:1203:11827:14904
         ----AGCTGGTTCACATGATCAACTGGGCGAAGAGAGGTGCCAG|TTGGACAGAGA---------------
                 SEQUENCER02:108:A81685ABXX:5:2205:21082:6325
         --------GGTTCACATGATCAACTGGGTGAAGAGAGGTGCCAG|TTGGACAGAGAGACT-----------
                 SEQUENCER02:108:A81685ABXX:5:1104:12687:113021
```

FIGURE 3.9A

```
---------GGTTCACACATGATCAACTGGGCGAAGAGGGTGCCAG|TTGGACAGAGAGACT---------------
--------SEQUENCER02:108:A81685ABXX:5:1204:2357:120122
---------GGTTCACACATGATCAACTGGGCGAAGAGGGTGCCAG|TTGGACAGAGAGACT---------------
--------SEQUENCER02:108:A81685ABXX:5:1205:12053:91013
---------GGTTCACACATGATCAACTGGGCGAAGAGGGTGCCAG|TTGGACAGAGAGACT---------------
--------SEQUENCER02:108:A81685ABXX:5:2103:2223:171443
---------GGTTCACACATGATCAACTGGGCGAAGAGGGTGCCAG|TTGGACAGAGAGACT---------------
--------SEQUENCER02:108:A81685ABXX:5:2106:13137:81386
---------GGTTCACACATGATCAACTGGGCGAAGAGGGTGCCAG|TTGGACAGAGAGACT---------------
--------SEQUENCER02:108:A81685ABXX:5:2108:4637:144122
---------GGTTCACACATGATCAACTGGGCGAAGAGGGTGCCAG|TTGGACAGAGAGACT---------------
--------SEQUENCER02:108:A81685ABXX:5:2207:14228:45009
------------CTGGGCGAAGAGGGTGCCAG|TTGGACAGAGAGACTCTGAAGATGTGAGC----------------
--------SEQUENCER02:108:A81685ABXX:5:2102:4621:147533
------------CTGGGCGAAGAGGGTGCCAG|TTGGACAGAGAGACTCTGAAGATGTGAGC----------------
--------SEQUENCER02:108:A81685ABXX:5:2206:15270:136958
-------------TGGGCGAAGAGGGTGCCAG|TTGGACAGAGAGACTCTGAAGATGTGAGC----------------
--------SEQUENCER02:108:A81685ABXX:5:1108:8079:158290
-------------TGGGCGAAGAGGGTGCCAG|TTGGACAGAGAGACTCTGAAGATGTGAGC----------------
--------SEQUENCER02:108:A81685ABXX:5:1208:5017:98422
--------------GGGCGAAGAGGGTGCCAG|TTGGACAGAGAGACTCTGAAGATGTGAGC----------------
--------SEQUENCER02:108:A81685ABXX:5:1102:4824:46331
--------------GGGCGAAGAGGGTGCCAG|TTGGACAGAGAGACTCTGAAGATGTGAGC----------------
--------SEQUENCER02:108:A81685ABXX:5:1105:12985:185350
--------------GGGCGAAGAGGGTGCCAG|TTGGACAGAGAGACTCTGAAGATGTGAGC----------------
--------SEQUENCER02:108:A81685ABXX:5:1201:3972:96232
--------------GGGCGAAGAGGGTGCCAG|TTGGACAGAGAGACTCTGAAGATGTGAGC----------------
--------SEQUENCER02:108:A81685ABXX:5:1207:12393:34521
--------------GGGCGAAGAGGGTGCCAG|TTGGACAGAGAGACTCTGAAGATGTGAGC----------------
--------SEQUENCER02:108:A81685ABXX:5:2102:17176:84097
--------------GGGCGAAGAGGGTGCCAG|TTGGACAGAGAGACTCTGAAGATGTGAGC----------------
--------SEQUENCER02:108:A81685ABXX:5:2102:8639:192289
```

FIGURE 3.9B

```
----------------------------------------------------GGGCGAAGAGGGTGCCAG|TTGGACAGAGAGAGACTCTGAAGATGTGAGC-------
                                    SEQUENCER02:108:A81685ABXX:5:2106:15804:196137
----------------------------------------AAGAGGGTGCCAG|TTGGACAGAGAGAGACTCTGAAGATGTGAGCGAAAGAGA-
                                    SEQUENCER02:108:A81685ABXX:5:2105:11507:6200
AGAGGGTGCCAG|TTGGACAGAGAGAGACTCTGAAGATGTGAGCGAAAGAGAC------------------------------------
                                    SEQUENCER02:108:A81685ABXX:5:1104:3911:136103
AGAGGGTGCCAG|TTGGACAGAGAGAGACTCTGAAGATGTGAGCGAAAGAGAC------------------------------------
                                    SEQUENCER02:108:A81685ABXX:5:1105:1505:102456
AGAGGGTGCCAG|TTGGACAGAGAGAGACTCTGAAGATGTGAGCGAAAGAGAC------------------------------------
                                    SEQUENCER02:108:A81685ABXX:5:1107:5455:44119
AGAGGGTGCCAG|TTGGACAGAGAGAGACTCTGAAGATGTGAGCGAAAGAGAC------------------------------------
                                    SEQUENCER02:108:A81685ABXX:5:2208:6864:14881
GAGGGTGCCAG|TTGGACAGAGAGAGACTCTGAAGATGTGAGCGAAAGAGACT-----------------------------------
                                    SEQUENCER02:108:A81685ABXX:5:1108:2000:49954
GAGGGTGCCAG|TTGGACAGAGAGAGACTCTGAAGATGTGAGCGAAAGAGACT-----------------------------------
                                    SEQUENCER02:108:A81685ABXX:5:2107:10873:145315
GAGGGTGCCAG|TTGGACAGAGAGAGACTCTGAAGATGTGAGCGAAAGAGACT-----------------------------------
                                    SEQUENCER02:108:A81685ABXX:5:2107:7790:24764
GAGGGTGCCAG|TTGGACAGAGAGAGACTCTGAAGATGTGAGCGAAAGAGACT-----------------------------------
                                    SEQUENCER02:108:A81685ABXX:5:2207:13558:143529
AGGGTGCCAG|TTGGACAGAGAGAGACTCTGAAGATGTGAGCGAAAGAGACTC----------------------------------
                                    SEQUENCER02:108:A81685ABXX:5:1202:11431:24810
```

FIGURE 3.9C

```
          ---GGGTGCCAG|TTGGACAGAGAGACTCTGAAGATGTGAGCGAAAGAGACTCC---------
                      SEQUENCER02:108:A81685ABXX:5:1108:2279:134558
          ----GGTGCCAG|TTGGACAGAGAGACTCTGAAGATGTGAGCGAAAGAGACTCCG--------
                      SEQUENCER02:108:A81685ABXX:5:1102:10581:48849
          ----GGTGCCAG|TTGGACAGAGAGACTCTGAAGATGTGAGCGAAAGAGACTCCG--------
                      SEQUENCER02:108:A81685ABXX:5:2106:2358:121653
          ----GGTGCCAG|TTGGACAGAGAGACTCTGAAGATGTGAGCGAAAGAGACTCCG--------
                      SEQUENCER02:108:A81685ABXX:5:2206:20167:77195
          -----GTGCCAG|TTGGACAGAGAGACTCTGAAGATGTGAGCGAAAGAGACTCCGA-------
                      SEQUENCER02:108:A81685ABXX:5:1104:10728:181479
          -----GTGCCAG|TTGGACAGAGAGACTCTGAAGATGTGAGCGAAAGAGACTCCGA-------
                      SEQUENCER02:108:A81685ABXX:5:1191:15191:8088
          -----GTGCCAG|TTGGACAGAGAGACTCTGAAGATGTGAGCGAAAGAGACTCCGA-------
                      SEQUENCER02:108:A81685ABXX:5:1107:16417:103315
          ------TGCCAG|TTGGACAGAGAGACTCTGAAGATGTGAGCGAAAGAGACTCCGAT------
                      SEQUENCER02:108:A81685ABXX:5:1204:3397:130126
          -------GCCAG|TTGGACAGAGAGACTCTGAAGATGTGAGCGAAAGAGACTCCGATA-----
                      SEQUENCER02:108:A81685ABXX:5:1205:12503:178749
          ###############################################################
          108GCCAAT_5   +chr6:152265643_+chr6:151669846  ESR1_AKAP12  donor_template
          **************  *********************************************
```

FIGURE 3.9D

```
GGCAGACAGGGAGCTGGTTCACATGATCAACTGGGCGAAGAGGGTGCCAG|GCTTTGTGGATTTGACCCTCCATGATCAGGTCCACCTT
CTAGAATGTGCC   junction_+chr6_152265643_+chr6_152332791_NM_000125
-------------------ACTGGGCGAAGAGGGTGCCAG|GCTTTGTGGATTTGACCCTCCATGATCAG-------
               SEQUENCER02:108:A81685ABXX:5:1107:11708:43604
-------------------ACTGGGCGAAGAGGGTGCCAG|GCTTTGTGGATTTGACCCTCCATGATCAG-------
               SEQUENCER02:108:A81685ABXX:5:1107:4191:69418
-------------------ACTGGGCGAAGAGGGTGCCAG|GCTTTGTGGATTTGACCCTCCATGATCAG-------
               SEQUENCER02:108:A81685ABXX:5:2104:20446:8401
-------------------ACTGGGCGAAGAGGGTGCCAG|GCTTTGTGGATTTGACCCTCCATGATCAG-------
               SEQUENCER02:108:A81685ABXX:5:2106:5051:53348
-------------------CTGGGCGAAGAGGGTGCCAG|GCTTTGTGGATTTGACCCTCCATGATCAGG------
               SEQUENCER02:108:A81685ABXX:5:1208:9185:89344
---------------------GGGCGAAGAGGGTGCCAG|GCTTTGTGGATTTGACCCTCCATGATCAGGTC----
               SEQUENCER02:108:A81685ABXX:5:1102:7662:158043
---------------------GGGCGAAGAGGGTGCCAG|GCTTTGTGGATTTGACCCTCCATGATCAGGTC----
               SEQUENCER02:108:A81685ABXX:5:1106:10849:63102
---------------------GGGCGAAGAGGGTGCCAG|GCTTTGTGGATTTGACCCTCCATGATCAGGTC----
               SEQUENCER02:108:A81685ABXX:5:1107:14811:40789
---------------------GGGCGAAGAGGGTGCCAG|GCTTTGTGGATTTGACCCTCCATGATCAGGTC----
               SEQUENCER02:108:A81685ABXX:5:1107:1945:29902
---------------------GGGCGAAGAGGGTGCCAG|GCTTTGTGGATTTGACCCTCCATGATCAGGTC----
               SEQUENCER02:108:A81685ABXX:5:1201:21065:124411
---------------------GGGCGAAGAGGGTGCCAG|GCTTTGTGGATTTGACCCTCCATGATCAGGTC----
               SEQUENCER02:108:A81685ABXX:5:1202:4442:179188
---------------------GGGCGAAGAGGGTGCCAG|GCTTTGTGGATTTGACCCTCCATGATCAGGTC----
               SEQUENCER02:108:A81685ABXX:5:1203:5894:84909
---------------------GGGCGAAGAGGGTGCCAG|GCTTTGTGGATTTGACCCTCCATGATCAGGTC----
               SEQUENCER02:108:A81685ABXX:5:1205:18919:112483
---------------------GGGCGAAGAGGGTGCCAG|GCTTTGTGGATTTGACCCTCCATGATCAGGTC----
               SEQUENCER02:108:A81685ABXX:5:1208:20532:152243
---------------------GGGCGAAGAGGGTGCCAG|GCTTTGTGGATTTGACCCTCCATGATCAGGTC----
               SEQUENCER02:108:A81685ABXX:5:2101:5113:69724
```

FIGURE 3.9E

```
------------------------------GGGCGAAGAGGGTGCCAG|GCTTTGTGGATTTGACCCTCCATGATCAGGTC------    SEQUENCER02:108:A81685ABXX:5:2101:5765:102650
-----------------------------AGGGCGAAGAGGGTGCCAG|GCTTTGTGGATTTGACCCTCCATGATCAGG--------    SEQUENCER02:108:A81685ABXX:5:2103:1727:71583
----------------------------GAGGGCGAAGAGGGTGCCAG|GCTTTGTGGATTTGACCCTCCATGATCAGGTC------    SEQUENCER02:108:A81685ABXX:5:2105:16652:79784
---------------------------AGAGGGCGAAGAGGGTGCCAG|GCTTTGTGGATTTGACCCTCCATGATCAGGTC------    SEQUENCER02:108:A81685ABXX:5:2106:1455:67696
-------------------------ACAGAGGGCGAAGAGGGTGCCAG|GCTTTGTGGATTTGACCCTCCATGATCAGGTC------    SEQUENCER02:108:A81685ABXX:5:2106:8816:21348
----------------------GAAACAGAGGGCGAAGAGGGTGCCAG|GCTTTGTGGATTTGACCCTCCATGATCAGGTC------    SEQUENCER02:108:A81685ABXX:5:2107:10999:164956
----------------------GAAACAGAGGGCGAAGAGGGTGCCAG|GCTTTGTGGATTTGACCTTCCATGATCAGGTC------    SEQUENCER02:108:A81685ABXX:5:2205:16036:88472
---------------------AGAAACAGAGGGCGAAGAGGGTGCCAG|GCTTTGTGGATTTGACCCTCCATGATCAGGTC------    SEQUENCER02:108:A81685ABXX:5:2206:16424:129897
----------------------GAAACAGAGGGCGAAGAGGGTGCCAG|GCTTTGTGGATTTGACCCGCCATGATCAGGTC------    SEQUENCER02:108:A81685ABXX:5:2206:2776:29404
---------------------AGAAACAGAGGGCGAAGAGGGTGCCAG|GCTTTGTGGATTTGACCCTCCATGATCAGGTC------    SEQUENCER02:108:A81685ABXX:5:2208:16755:169854
###############################################################################           
###############                                                                            
108GCCAAT_5            +chr6:152265643_+chr6:151669846     ESR1_AKAP12     acceptor_template
*****************************************************************************************
TCAAGGAGCCCTAAACAGCCAGGAGGAAGAAGTCATTGTCACAGAGG|TTGGACAGAGACTCTGAAGATGTGAGCAAAAGAGAC
TCCGATAAAGAG  junction_+chr6_151627038_+chr6_151669846_NM_005100
###############                                                                            
###############################################################################           
108GCCAAT_5            +chr6:152265643_+chr6:151669846     ESR1_AKAP12     donor_genomic_template
*****************************************************************************************
```

FIGURE 3.9F

```
GGCAGAGACAGGAGGAGCTGGTTCACATGATCAACTGGGCGAAGAGGGTGCCAGGTAAGAATGCGAAGCGCAGCTTTTAAGAGTCAATAGCT
TTTCAAGAACTT      junction_+chr6_152265643_NM_000125
------------      ------SEQUENCER02:108:A81685ABXX:5:1107:6125:145924   ACTGGGCGAAGAGGGTGCCAG|GTAAGAATGCGAAGCGCAGCTTTTAAGAG-------
------------      ------SEQUENCER02:108:A81685ABXX:5:1208:6985:164790   ACTGGGCGAAGAGGGTGCCAG|GTAAGAATGCGAAGCGCAGCTTTTAAGAG-------
------------      ------SEQUENCER02:108:A81685ABXX:5:2202:14323:189063  ACTGGGCGAAGAGGGTGCCAG|GTAAGAATGCGAAGCGCAGCTTTTAAGAG-------
------------      ------SEQUENCER02:108:A81685ABXX:5:2202:18850:21958   --TGGGCGAAGAGGGTGCCAG|GTAAGAATGCGAAGCGCAGCTTTTAAGAGT------
------------      ------SEQUENCER02:108:A81685ABXX:5:1104:6085:29702    --TGGGCGAAGAGGGTGCCAG|GTAAGAATGCGAAGCGCAGCTTTTAAGAGT------
------------      ------SEQUENCER02:108:A81685ABXX:5:1208:17455:74498   --TGGGCGAAGAGGGTGCCAG|GTAAGAATGCGAAGCGCAGCTTTTAAGAGTC-----
------------      ------SEQUENCER02:108:A81685ABXX:5:1101:2180:185890   ---GGCGAAGAGGGTGCCAG|GTAAGAATGCGAAGCGCAGCTTTTAAGAGTCA-----
------------      ------SEQUENCER02:108:A81685ABXX:5:1102:20338:34929   ---GGCGAAGAGGGTGCCAG|GTAAGAATGCGAAGCGCAGCTTTTAAGAGTCA-----
------------      ------SEQUENCER02:108:A81685ABXX:5:1108:18121:166383  ---GGCGAAGAGGGTGCCAG|GTAAGAATGCGAAGCGCAGCTTTTAAGAGTCA-----
------------      ------SEQUENCER02:108:A81685ABXX:5:1206:16794:169687  ---GGCGAAGAGGGTGCCAG|GTAAGAATGCGAAGCGCAGCTTTTAAGAGTCA-----
------------      ------SEQUENCER02:108:A81685ABXX:5:1206:6309:184899   ---GGCGAAGAGGGTGCCAG|GTAAGAATGCGAAGCGCAGCTTTTAAGAGTCA-----
------------      ------SEQUENCER02:108:A81685ABXX:5:1208:15333:138980  ---GGCGAAGAGGGTGCCAG|GTAAGAATGCGAAGCGCAGCTTTTAAGAGTC------
------------      ------SEQUENCER02:108:A81685ABXX:5:2105:15457:94759   ---GGCGAAGAGGGTGCCAG|GTAAGAATGCGAAGCGCAGCTTTTAAGAGTCA-----
------------      ------SEQUENCER02:108:A81685ABXX:5:2106:18341:45734   ---GGCGAAGAGGGTGCCAG|GTAAGAATGCGAAGCGCAGCTTTTAAGAGTCA-----
------------      ------SEQUENCER02:108:A81685ABXX:5:2206:5811:166293   ---GGCGAAGAGGGTGCCAG|GTAAGAATGCGAAGCGCAGCTTTTAAGAGTCA-----
```

FIGURE 3.9G

```
                                        -----GGGTGAAGAGAGGGTGCCAG|GTAAGAATGCGAAGCGCAGCTTTTAAGAGTCA-----
    SEQUENCER02:108:A81685ABXX:5:2206:9906:54012
                                        -----GGCGAAGAGAGGGTGCCAG|GTAAGAATGCGAAGCGCAGCTTTTAAGAGTCAA----
    SEQUENCER02:108:A81685ABXX:5:2207:17541:171932
                                        -----GGCGAAGAGAGGGTGCCAG|GTAAGAATGCGAAGCGCAGCTTTTAAGAGTCA-----
    SEQUENCER02:108:A81685ABXX:5:2207:19184:82365
                                        --------AAGAGGGTGCCAG|GTAAGAATGCGAAGCGCAGCTTTTAAGAGTCAATAGC-
    SEQUENCER02:108:A81685ABXX:5:1206:6950:33002
                                        --------AAGAGGGTGCCAG|GTAAGAATGCGAAGCGCAGCTTTTAAGAGTCAATAGC-
    SEQUENCER02:108:A81685ABXX:5:1206:8232:132292
                                        --------AAGAGGGTGCCAG|GTAAGAATGCGAAGCGCAGCTTTTAAGAGTCAATAGC-
    SEQUENCER02:108:A81685ABXX:5:2104:14194:34940
                                        --------AAGAGGGTGCCAG|GTAAGAATGCGAAGCGCAGCTTTTAAGAGTCAATAGC-
    SEQUENCER02:108:A81685ABXX:5:2108:20942:193684
                                        --------AAGAGGGTGCCAG|GTAAGAATGCGAAGCGCAGCTTTTAAGAGTCAATAGC-
    SEQUENCER02:108:A81685ABXX:5:2201:2800:147694
                                        --------AAGAGGGTGCCAG|GTAAGAATGCGAAGCGCAGCTTTTAAGAGTCAATAGC-
    SEQUENCER02:108:A81685ABXX:5:2203:18318:62244
                                        --------AAGAGGGTGCCAG|GTAAGAATGCGAAGCGCAGCTTTTAAGAGTCAATAGC-
    SEQUENCER02:108:A81685ABXX:5:2204:10006:113550

AGAGGGTGCCAG|GTAAGAATGCGAAGCGCAGCCTTTAAGAGTCAATAGCT-------
    SEQUENCER02:108:A81685ABXX:5:1101:6131:98335
AGAGGGTGCCAG|GTAAGAATGCGAAGCGCAGCTTTTAGGAGTCAATAGCT-------
    SEQUENCER02:108:A81685ABXX:5:1107:13865:65614
AGAGGGTGCCAG|GTAAGAATGCGAAGCGCAGCTTTTAAGAGTCAATAGCT-------
    SEQUENCER02:108:A81685ABXX:5:1108:18517:157022
AGAGGGTGCCAG|GTAAGAATGCGAAGCGCAGCTTTTAAGAGTCAATAGCT-------
    SEQUENCER02:108:A81685ABXX:5:1204:14961:61239
```

FIGURE 3.9H

```
AGAGGGTGCCAG|GTAAGAATGCGAAGCGCAGCTTTTAAGAGTCAATAGCT-----------------------
          SEQUENCER02:108:A81685ABXX:5:1207:15296:157275
-----------------------AGAGGGTGCCAG|GTAAGAATGCGAAGCGCAGCTTTTAAGAGTCAATAGC-
          SEQUENCER02:108:A81685ABXX:5:1207:17582:53002

AGAGGGTGCCAG|GTAAGAATGCGAAGCGCAGCTTTTAAGAGTCAATAGCT-----------------------
          SEQUENCER02:108:A81685ABXX:5:2102:5954:95135

AGAGGGTGCCAG|GTAAGAATGCGAAGCGCAGCTTTTAAGAGTCAATAGCT-----------------------
          SEQUENCER02:108:A81685ABXX:5:2106:17408:105873

AGAGGGTGCCAG|GTAAGAATGCGAAGCGCAGCTTTTAAGAGTCAATAGCT-----------------------
          SEQUENCER02:108:A81685ABXX:5:2107:1327:105486

AGAGGGTGCCAG|GTAAGAATGCGAAGCGCAGCCTTTTAAGAGTCAATAGCT----------------------
          SEQUENCER02:108:A81685ABXX:5:2203:19652:162457

GAGGGTGCCAG|GTAAGAATGCGAAGCGCAGCTTTTAAGAGTCAATAGCTT-----------------------
          SEQUENCER02:108:A81685ABXX:5:1102:5465:36223

GAGGGTGCCAG|GTAAGAATGCGAAGCGCAGCTTTTAAGAGTCAATAGCTT-----------------------
          SEQUENCER02:108:A81685ABXX:5:1105:5188:161165

GAGGGTGCCAG|GTAAGAATGCGAAGCGCAGCTTTTAAGAGTCAATAGCTT-----------------------
          SEQUENCER02:108:A81685ABXX:5:2103:14771:99131

GAGGGTGCCAG|GTAAGAATGCGAAGCGCAGCTTTTAAGAGTCAATAGCTT-----------------------
          SEQUENCER02:108:A81685ABXX:5:2206:2302:146483

GAGGGTGCCAG|GTAAGAATGCGAAGCGCAGCTTTTAAGAGTCAATAGCTT-----------------------
          SEQUENCER02:108:A81685ABXX:5:2207:8256:73507
```

FIGURE 3.9I

```
|AGGGTGCCAG|GTAAGAATGCGAAGCGCAGCTTTTAAGAGTTAATAGCTTT|---
            SEQUENCER02:108:A81685ABXX:5:1201:19723:153015

|AGGNTGCCAG|GTAAGAATGCGAAGCGCAGCTTTTAAGAGTCAATAGCTTT|---
            SEQUENCER02:108:A81685ABXX:5:1205:21332:192391

|AGGGTGCCAG|GTAAGAATGCGAAGCGCAGCTTTTAAGAGTCAATAGCTTT|---
            SEQUENCER02:108:A81685ABXX:5:1205:3322:153053

|AGGGTGCCAG|GTAAGAATGCGAAGCGCAGCTTTTAAGAGTCAATAGCTTT|---
            SEQUENCER02:108:A81685ABXX:5:1207:1951:44843

|AGGGTGCCAG|GTAAGAATGCGAAGCGCAGCTTTTAAGAGTCAATAGCTTT|---
            SEQUENCER02:108:A81685ABXX:5:2101:17082:8142

|AGGGTGCCAG|GTAAGAATGCGAAGCGCAGCTTTTAAGAGTCAATAGCTTT|---
            SEQUENCER02:108:A81685ABXX:5:2104:14389:97516

|AGGGTGCCAG|GTAAGAATGCGAAGCGCAGCTTTTAAGAGTCAATAGCTTT|---
            SEQUENCER02:108:A81685ABXX:5:2106:12375:169623

|AGGGTGCCAG|GTAAGAATGCGAAGCGCAGCTTTTAAGAGTCAATAGCTTT|---
            SEQUENCER02:108:A81685ABXX:5:2108:5360:134455

|AGGGTGCCAG|GTAAGAATGCGAAGCGCAGCTTTTAAGAGTCAATAGCTTT|---
            SEQUENCER02:108:A81685ABXX:5:2201:11348:169892

|AGGGTGCCAG|GTAAGAATGCGAAGCGTAGCTTTTAAGAGTCAATAGCTTT|---
            SEQUENCER02:108:A81685ABXX:5:2201:13233:111634

|AGGGTGCCAG|GTAAGAATGCGAAGCGCAGCTTTTAAGAGTCAATAGCTT|---
            SEQUENCER02:108:A81685ABXX:5:2202:2803:165736
```

FIGURE 3.9J

```
AGGGTGCCAG|GTAAGAATGCGAAGCGCAGCTTTTAAGAGTCAATAGCTTT-------
    SEQUENCER02:108:A81685ABXX:5:2202:7987:182960

GGGTGCCAG|GTAAGAATGCGAAGCGCAGCTTTTAAGAGTCAATAGCTTT-------
    SEQUENCER02:108:A81685ABXX:5:1205:11118:143229

GGTGCCAG|GTAAGAATGCGAAGCGCAGCTTTTAAGAGTCAATAGCTTTTC------
    SEQUENCER02:108:A81685ABXX:5:1104:10703:52601

GGTGCCAG|GTAAGAATGCGAAGCGCAGCTTTTAAGAGTCAATAGTTTTTC------
    SEQUENCER02:108:A81685ABXX:5:1105:8106:45260

GGTGCCAG|GTAAGAATGCGAAGCGCAGCTTTTAAGAGTCAATAGCTTTT-------
    SEQUENCER02:108:A81685ABXX:5:1108:16388:39684

GGTGCCAG|GTAAGAATGCGAAGCGCAGCTTTTAAGAGTCAATAGCTTTT-------
    SEQUENCER02:108:A81685ABXX:5:1206:6748:162924

GTGCCAG|GTAAGAATGCGAAGCGCAGCTTTTAAGAGTCAATAGCTTTTCA------
    SEQUENCER02:108:A81685ABXX:5:1106:14596:200225

GTGCCAG|GTAAGAATGCGAAGCGCAGCTTTTAAGAGCCAATAGCTTTTCA------
    SEQUENCER02:108:A81685ABXX:5:1201:1668:185711

GTGCCAG|GTAAGAATGCGAAGCGCAGCTTTTAAGAGTCAATAGCTTTCA-------
    SEQUENCER02:108:A81685ABXX:5:1202:7324:21275

GTGCCAG|GTAAGAATGCGAAGCGCAGCTTTTAAGAGTCAATAGCTTTCA-------
    SEQUENCER02:108:A81685ABXX:5:1208:10491:159614

GTGCCAG|GTAAGAATGCGAAGCGCAGCTTTTAAGAGTCAATAGCTTCTCA------
    SEQUENCER02:108:A81685ABXX:5:2104:3457:128349
```

FIGURE 3.9K

```
----                                                                   ----
GTGCCAG|GTAAGAATGCGAAGCGCAGCTTTTAAGAGTCAATAGCTTTTCA----
        SEQUENCER02:108:A81685ABXX:5:2106:2353:92170
----                                                                   ----
GTGCCAG|GTAAGAATGCGAAGCGCAGCTTTTAAGAGTCAATAGCTTTTCA----
        SEQUENCER02:108:A81685ABXX:5:2108:8094:36442
----                                                                   ----
GTGCCAG|GTAAGAATGCGAAGCGCAGCTTTTAAGAGTCAATAGCTTTTCA----
        SEQUENCER02:108:A81685ABXX:5:2203:20006:56897
----                                                                   ----
GTGCCAG|GTAAGAATGCGAAGCGCAGCTTTTAAGAGACAATAGCTTTTCA----
        SEQUENCER02:108:A81685ABXX:5:2204:3176:93743
----                                                                   ----
TGCCAG|GTAAGAATGCGAAGCGCAGCTTTTAAGAGTCAATAGCTTTTCAA----
        SEQUENCER02:108:A81685ABXX:5:1103:21043:52705
----                                                                   ----
TGCCAG|GTAAGAATGCGAAGCGCAGCTTTTAAGAGTCAATAGCTTTTCAA----
        SEQUENCER02:108:A81685ABXX:5:1106:11308:162566
----                                                                   ----
TGCCAG|GTAAGAATGCGAAGCGCAGCTTTTAAGAGTCAATAGCTTTTCAA----
        SEQUENCER02:108:A81685ABXX:5:1108:3445:143663
----                                                                   ----
TGCCAG|GTAAGAATGTGAAGCGCAGCTTTTAAGAGTCAATAGCTTTTCAA----
        SEQUENCER02:108:A81685ABXX:5:1108:3638:38237
----                                                                   ----
TGCCAG|GTAAGAATGCGAAGCGCAGCTTTTAAGAGTCAATAGCTTTTCAA----
        SEQUENCER02:108:A81685ABXX:5:2102:4214:194158
----                                                                   ----
TGCCAG|GTAAGAATGCGAAGCGCAGCTTTTAAGAGTCAATAGCTTTTCAA----
        SEQUENCER02:108:A81685ABXX:5:2104:17528:114410
----                                                                   ----
TGCCAG|GTAAGAATGCGAAGCGCAGCTTTTAAGAGTTAATAGCTTTTCAA----
        SEQUENCER02:108:A81685ABXX:5:2107:1757:14547
```

FIGURE 3.9L

```
TGCCAG|GTAAGAATGCGAAGCGCAGCTTTTAAGAGTCAATAGCTTTTCA------
       SEQUENCER02:108:A81685ABXX:5:2108:11345:185145

TGCCAG|GTAAGAATGCGAAGCGCAGCTTTTAAGAGTCAATAGCTTTTCAA------
       SEQUENCER02:108:A81685ABXX:5:2201:7173:65429

TGCCAG|GTAAGAATGCGAAGCGCAGCTTTTAAGAGTCAATAGCTTTTCAA------
       SEQUENCER02:108:A81685ABXX:5:2208:11313:162352

GCCAG|GTAAGAATGCGAAGCGCAGCTTTTAAGAGTCAATAGCTTTTCAAG------
      SEQUENCER02:108:A81685ABXX:5:1101:17264:49376

GCCAG|GTAAGAATGCGAAGCGCAGCTTTTAAGAGTCAATAGCTTTTCAAG------
      SEQUENCER02:108:A81685ABXX:5:1101:19496:28808

GCCAG|GTAAGAATGCGAAGCGCAGCTTTTAAGAGTCAATAGCTTTTCAAG------
      SEQUENCER02:108:A81685ABXX:5:1101:9880:52994

GCCAG|GTAAGAATGCGAAGCGCAGCTTTTAAGAGTCAATAGCTTTTCAAG------
      SEQUENCER02:108:A81685ABXX:5:1102:16945:108157

GCCAG|GTAAGAATGCGAAGCGCAGCTTTTAAGAGTCAATAGCTTTTCAAG------
      SEQUENCER02:108:A81685ABXX:5:1102:9257:159521

GCCAG|GTAAGAATGCGAAGCGCAGCTTTTAAGAGTCAATAGCTTTTCAAG------
      SEQUENCER02:108:A81685ABXX:5:1103:17379:148510

GCCAG|GTAAGAATGCGAAGCGCAGCTTTTAAGAGTCAATAGCTTTTCAAG------
      SEQUENCER02:108:A81685ABXX:5:1103:20514:98795

GCCAG|GTAAGAATGCGAAGCGCAGCTTTTAAGAGTCAATAGCTTTTCAAG------
      SEQUENCER02:108:A81685ABXX:5:1105:11061:120015
```

FIGURE 3.9M

```
GCCAG|GTAAGAATGCGAAGCGCAGCTTTTAAGAGTCAATAGCTTTTCAA-----
      SEQUENCER02:108:A81685ABXX:5:1105:13584:151598

GCCAG|GTAAGAATGCGAAGCGCAGCTTTTAAGAGTCAATAGCTTTTCAA-----
      SEQUENCER02:108:A81685ABXX:5:1105:17012:25244

GCCAG|GTAAGAATGCGAAGCGCAGCTTTTAAGAGTCAATAGCTTTTCAAG----
      SEQUENCER02:108:A81685ABXX:5:1106:19874:165943

GCCAG|GTAAGAATGCGAAGCGCAGCTTTTAAGAGTCAATAGCTTTTCAAG----
      SEQUENCER02:108:A81685ABXX:5:1107:14074:134298

GCCAG|GTAAGAATGCGAAGCGCAGCTTTTAAGAGTCAATAGCTTTTCAA-----
      SEQUENCER02:108:A81685ABXX:5:1108:3309:190660

GCCAG|GTAAGAATGCGAAGCGCAGCTTTTAAGAGTCAATAGCTTTTCAAG----
      SEQUENCER02:108:A81685ABXX:5:1201:15512:113569

GCCAG|GTAAGAATGCGAAGCGCAGCTTTTAAGAGTCAATAGCTTTTCAAG----
      SEQUENCER02:108:A81685ABXX:5:1203:16687:176798

GCCAG|GTAAGAATGCGAAGCGCAGCTTTTAAGAGTCAATAGCTTTTCAAG----
      SEQUENCER02:108:A81685ABXX:5:1206:12999:4904

GCCAG|GTAAGAATGCGAAGCGCAGCTTTTAAGAGTCAATAGCTTTTCAAG----
      SEQUENCER02:108:A81685ABXX:5:1206:16268:69029

GCCAG|GTAAGAATGCGAAGCGCAGCTTTTAAGAGTCAATAGCTTTTCAAG----
      SEQUENCER02:108:A81685ABXX:5:1206:8538:150221

GCCAG|GTAAGAATGCGAAGCGCAGCTTTTAAGAGTCAATAGCTTTTCAA-----
      SEQUENCER02:108:A81685ABXX:5:1207:12874:143694
```

FIGURE 3.9N

```
GCCAG|GTAAGAATGCGAAGCGCAGCTTTTAAGAGTCAATAGCTTTTCAAG-----|
      SEQUENCER02:108:A81685ABXX:5:1207:17112:182971

GCCAG|GTAAGAATGCGAAGCGCAGCTTTTAAGAGTCAATAGCTTTTCAAG-----|
      SEQUENCER02:108:A81685ABXX:5:1207:19785:164137

GCCAG|GTAAGAATGCGAAGCGCAGCTTTTAAGAGTCAATAGCTTTTCAAG-----|
      SEQUENCER02:108:A81685ABXX:5:1207:2316:66808

GCCAG|GTAAGAATGCGAAGCGCAGCTTTTAAGAGTCAATAGCTTTTCAAG-----|
      SEQUENCER02:108:A81685ABXX:5:1207:5571:31095

GCCAG|GTAAGAATGCGAAGCGCAGCTTTTAAGAGTCAATAGCTTTTCAAG-----|
      SEQUENCER02:108:A81685ABXX:5:1208:20212:69785

GCCAG|GTAAGAATGCGAAGCGCAGCTTTTAAGAGTCAATAGCTTTTCAAG-----|
      SEQUENCER02:108:A81685ABXX:5:1208:21232:145741

GCCAG|GTAAGAATGCGAAGCGCAGCTTTTAAGAGTCAATAGCTTTTCAAG-----|
      SEQUENCER02:108:A81685ABXX:5:2101:6664:139482

GCCAG|GTAAGAATGCGAAGCGCAGCTAGCTTTTAAGAGTCAATAGCTTTTCAAG-----|
      SEQUENCER02:108:A81685ABXX:5:2101:7187:154982

GCCAG|GTAAGAATGCGAAGCGCAGCTTTTAAGAGTCAATAGCTTTTCAAG-----|
      SEQUENCER02:108:A81685ABXX:5:2103:7137:158898

GCCAG|GTAAGAATGCGAAGCGCAGCTTTTAAGAGTCAATAGCTTTTCAAG-----|
      SEQUENCER02:108:A81685ABXX:5:2103:7960:144262

GCCAG|GTAAGAATGCGAAGCGCAGCTTTTAAGAGTCAATAGTTTTTCAAG-----|
      SEQUENCER02:108:A81685ABXX:5:2104:1684:126144
```

FIGURE 3.9O

```
|GCCAG|GTAAGAATGCGAAGCGCAGCTTTTAAGAGTTAATAGCTTTTCAAG-----|
|     |SEQUENCER02:108:A81685ABXX:5:2104:3788:16629      |
|                                                         |
|GCCAG|GTAAGAATGCGAAGCGCAGCTTTTAAGAGTCAATAGCTTTTCAAG-----|
|     |SEQUENCER02:108:A81685ABXX:5:2105:4480:61848      |
|                                                         |
|GCCAG|GTAAGAATGCGAAGCGCAGCTTTTAAGAGTCAATAGCTTTTCAAG-----|
|     |SEQUENCER02:108:A81685ABXX:5:2105:5912:44851      |
|                                                         |
|GCCAG|GTAAGAATGCGAAGCGTAGCTTTTAAGAGTCAATAGCTTTTCAAG-----|
|     |SEQUENCER02:108:A81685ABXX:5:2106:13853:73168     |
|                                                         |
|GCCAG|GTAAGAATGCGAAGCGCAGCTTTTAAGAGTCAATAGCTTTTCAAG-----|
|     |SEQUENCER02:108:A81685ABXX:5:2107:4150:112684     |
|                                                         |
|GCCAG|GTAAGAATGCGAAGCGCAGCTTTTAAGAGTCAATAGTTTTTCAAG-----|
|     |SEQUENCER02:108:A81685ABXX:5:2108:1429:124667     |
|                                                         |
|GCCAG|GTAAGAATGCGAAGCGCAGCTTTTAAGAGTCAATAGCTTTTCAAG-----|
|     |SEQUENCER02:108:A81685ABXX:5:2108:15639:180120    |
|                                                         |
|GCCAG|GTAAGAATGCGAAGCGCAGCTTTTAAGAGTCAATAGCTTTTCAAG-----|
|     |SEQUENCER02:108:A81685ABXX:5:2108:18902:155725    |
|                                                         |
|GCCAG|GTAAGAATGCGAAGCGCAGCTTTTAAGAGTCAATAGCTTTTCAA------|
|     |SEQUENCER02:108:A81685ABXX:5:2202:14413:151874    |
|                                                         |
|GCCAG|GTAAGAATGCGAAGCGCAGCTTTTAAGAGTCAATAGCTTTTCAAG-----|
|     |SEQUENCER02:108:A81685ABXX:5:2202:18077:134115    |
|                                                         |
|GCCAG|GTAAGAATGCGAAGCGCAGCTTTTAAGAGTCAATAGCTTTTCAAG-----|
|     |SEQUENCER02:108:A81685ABXX:5:2203:8536:125320     |
```

FIGURE 3.9P

```
         GCCAG|GTAAGAATGCGAAGCGCAGCTTTTAAGAGTCAATAGCTTTTCAAG-----
               SEQUENCER02:108:A81685ABXX:5:2205:3832:144616
         |                                                      |
         GCCAG|GTAAGAATGCGAAGCGCAGCTTTTAAGAGTCAATAGCTTTTCAAG-----
               SEQUENCER02:108:A81685ABXX:5:2206:2307:138978
         |                                                      |
         GCCAG|GTAAGAATGCGAAGCGCAGCTTTTAAGAGTCAATAGTTTTTCAAG-----
               SEQUENCER02:108:A81685ABXX:5:2206:4238:108574
         |                                                      |
         GCCAG|GTAAGAATGCGAAGCGCAGCTTTTAAGAGTCAATAGCTTTTCAAG-----
               SEQUENCER02:108:A81685ABXX:5:2206:5991:157451
         |                                                      |
         GCCAG|GTAAGAATGCGAAGCGCAGCTTTTAAGAGTCAATAGCTTTTCAAG-----
               SEQUENCER02:108:A81685ABXX:5:2207:14352:67660
         |                                                      |
         GCCAG|GTAAGAATGCGAAGCGCAGCTTTTAAGAGTCAATAGCTTTTCAAG-----
               SEQUENCER02:108:A81685ABXX:5:2207:5474:11560
         |                                                      |
         GCCAG|GTAAGAATGCGAAGCGCAGCTTTTAAGAGTCAATAGCTTTTCAAG-----
               SEQUENCER02:108:A81685ABXX:5:2208:19658:79895
         |                                                      |
         GCCAG|GTAAGAATGCGAAGCGCAGCTTTTAAGAGTTAATAGCTTTTCAAG-----
               SEQUENCER02:108:A81685ABXX:5:2208:6074:184333
         |                                                      |
         GCCAG|GTAAGAATGCGAAGCGCAGCTTTTAAGAGTCAATAGCTTTTCAA------
               SEQUENCER02:108:A81685ABXX:5:2208:6620:159420
         ########################################################
         108GCCAAT_5   +chr6:152265643 +chr6:151669846   ESR1_AKAP12
            acceptor_genomic_template
         ********************************************************
         **************
```

FIGURE 3.9Q

```
GTAATCACCTTTTCTCTTCTCCCACCCCCCGCCCCCTTTTTGTTAATAG|TTGGACAGAGAGACTCTGAAGATGTGAGCAAAGAGAC
TCCGATAAAGAG   junction_+chr6_151669846_NM_005100
########################################################################################
##########
```

FIGURE 3.9R

3.10 TEX10_PICALM
```
108GCCAAT_5      -chr9:103115054_-chr11:85742653    TEX10_PICALM   fusion_template
*****************************************************************************************
*********
CCTCGCTTGTCTTCTCGGGCTTCTCGCCCCGGCCGCGGCCGGGTCCTCAG|ACTTAATTCAGTGCACAAATGAGATGAATGTGAACATC
CCACAGTTGGCA  junction_-chr9_103115054_-chr11_85742653_NM_017746_NM_007166
--------------GCCGCGCCGGGTCCTCAG|ACTTAATTCAGTGCACAAATGAGATGAATGT-------
         SEQUENCER02:108:A81685ABXX:5:1105:15942:84727
--------------GCCGCGCCGGGTCCTCAG|ACTTAATTCAGTGCACAAATGAGATGAATGT-------
##########
         SEQUENCER02:108:A81685ABXX:5:1106:20547:15147

108GCCAAT_5      -chr9:103115054_-chr11:85742653    TEX10_PICALM   donor_template
*****************************************************************************************
*********
CCTCGCTTGTCTTCTCGGGCTTCTCGCCCCGGCCGCGGCCGGGTCCTCAG|TAGTCGAGAATGACTAAAAAGAAAACGCCAACATGA
TTTTCAAAAAGT  junction_-chr9_103115054_NM_017746
##########
         SEQUENCER02:108:A81685ABXX:5:1104:2059:176801

108GCCAAT_5      -chr9:103115054_-chr11:85742653    TEX10_PICALM   acceptor_template
*****************************************************************************************
*********
CAAGGCCACGACCCACAGAGATCATGGGCCCAAGAAAAAGCACCTGGACT|ACTTAATTCAGTGCACAAATGAGATGAATGTGAACATC
CCACAGTTGGCA  junction_-chr11_85779693_-chr11_85742653_NM_007166
---------CACGAGATCATGGGCCCAAGAAAAAGCACCTGGACT|ACTTAATTCAGT--
         SEQUENCER02:108:A81685ABXX:5:1104:2059:176801
```

FIGURE 3.10A

```
-------------------------------CACGAGATCATGGGGCCCAAGAAAAAGCACCTGGACT|ACTTAATTCAGT------------------------------
                               SEQUENCER02:108:A81685ABXX:5:1203:4566:197737
-----------------------------------TCATGGGTCCAAGAAAAAGCACCTGGACT|ACTTAATTCAGTGCACAAAT-------------------------
                                   SEQUENCER02:108:A81685ABXX:5:1102:11913:166341
-----------------------------------TCATGGGTCCAAGAAAAAGCACCTGGACT|ACTTAATTCAGTGCACAAAT-------------------------
                                   SEQUENCER02:108:A81685ABXX:5:1105:10830:117007
--------------------------------------TGGGCCCAAGAAAAAGCACCTGGACT|ACTTAATTCAGTGCACAAATGAG----------------------
                                      SEQUENCER02:108:A81685ABXX:5:1106:20410:29008
---------------------------------------GGGGCCCAAGAAAAAGCACCTGGACT|ACTTAATTCAGTGCACAAATGAGA--------------------
                                       SEQUENCER02:108:A81685ABXX:5:1205:10082:194315
----------------------------------------GGGGCCCAAGAAAAAGCACCTGGACT|ACTTAATTCAGTGCACAAATGAGA-------------------
                                        SEQUENCER02:108:A81685ABXX:5:2203:10255:44283
------------------------------------------GGGCCCAAGAAAAAGCACCTGGACT|ACTTAATTCAGTGCACAAATGAGAT------------------
                                          SEQUENCER02:108:A81685ABXX:5:2204:17695:92739
--------------------------------------------AAAGCACCTGGACT|ACTTAATTCAGTGCACAAATGAGATGAATGTGAACA--------------
                                            SEQUENCER02:108:A81685ABXX:5:2104:4655:143062
---------------------------------------------AAGCACCTGGACT|ACTTAATTCAGTGCACAAATGAGATGAATGTGAACAT-------------
                                             SEQUENCER02:108:A81685ABXX:5:2107:17157:104957
GGACT|ACTTAATTCAGTGCACAAATGAGATGAATGTGAACATCCCACAGT-------
      SEQUENCER02:108:A81685ABXX:5:1101:18639:64634
GGACT|ACTTAATTCAGTGCACAAATGAGATGAATGTGAACATCCCACAGT-------
      SEQUENCER02:108:A81685ABXX:5:1101:20011:80561
GGACT|ACTTAATTCAGTGCACAAATGAGATGAATGTGAACATCCCACAGT-------
      SEQUENCER02:108:A81685ABXX:5:1101:5897:59748
GGACT|ACTTAATTCAGTGCACAAATGAGATGAATGTGAACATCCCACAGT-------
      SEQUENCER02:108:A81685ABXX:5:1101:7111:152042
GGACT|ACTTAATTCAGTGCACAAATGAGATGAATGTGAACATCCCACAGT-------
      SEQUENCER02:108:A81685ABXX:5:1108:10740:3344
```

FIGURE 3.10B

```
GGACT|ACTTAATTCAGTGCACAAATGAGATGAATGTGAACATCCCACAGT----
       SEQUENCER02:108:A81685ABXX:5:1201:12182:167066

GGACT|ACTTAATTCAGTGCACAAATGAGATGAATGTGAACATCCCACAGT----
       SEQUENCER02:108:A81685ABXX:5:1203:18299:41816

GGACT|ACTTAATTCAGTGCACAAATGAGATGAATGTGAACATCCCACAGT----
       SEQUENCER02:108:A81685ABXX:5:1203:20710:70077

GGACT|ACTTAATTCAGTGCACAAATGAGATGAATGTGTACATCCCACAGT----
       SEQUENCER02:108:A81685ABXX:5:1204:19170:154572

GGACT|ACTTAATTCAGTGCACAAATGAGATGAATGTGAACATCCCACAGT----
       SEQUENCER02:108:A81685ABXX:5:1206:5466:39209

GGACT|ACTTAATTCAGTGCACAAATGAGATGAATGTGAACATCCCACAGT----
       SEQUENCER02:108:A81685ABXX:5:2105:9900:91493

GGACT|ACTTAATTCAGTGCACAAATGAGATGAATGTGAACATCCCACAGT----
       SEQUENCER02:108:A81685ABXX:5:2201:19197:17039

GGACT|ACTTAATTCAGTGCACAAATGAGATGAATGTGAACATCCCACAGT----
       SEQUENCER02:108:A81685ABXX:5:2201:4981:84791

GGACT|ACTTAATTCAGTGCACAAATGAGATGAATGTGAACATCCCACAGT----
       SEQUENCER02:108:A81685ABXX:5:2204:1155:118096

GGACT|ACTTAATTCAGTGCACAAATGAGATGAATGTGAACATCCCACAGT----
       SEQUENCER02:108:A81685ABXX:5:2205:8149:121520

GGACT|ACTTAATTCAGTGCACAAATGAGATGAATGTGAACATCCCACAGT----
       SEQUENCER02:108:A81685ABXX:5:2207:4421:89868
```

FIGURE 3.10C

```
##################################################################
108GCCAAT_5    -chr9:103115054_-chr11:85742653    TEX10_PICALM    donor_genomic_template
****************************************************************
CCTCGCTTGTCTTCTCGGGCTTCTCGCCCGGCCCGCGGCCGGGTCCTCAG|GTAAGCGGCCGTGCCCGTCGGCGCCGGTCCTCCGGG
GCGCGGACTGA    junction_-chr9_103115054_NM_017746
#################################################################
108GCCAAT_5    -chr9:103115054_-chr11:85742653    TEX10_PICALM
   acceptor_genomic_template
****************************************************************
TAAATAAAACCACAGAGGAAATTAATCATTTAAAAATTTTTTATTGCAG|ACTTAATTCAGTGCACAAATGAGATGAATGTGAACATC
CCACAGTTGGCA    junction_-chr11_85742653_NM_007166
#################################################################
TATTGCAG|ACTTAATTCAGTGCACAAATGAGATGAATGTGAACAGCCCAC------
    SEQUENCER02:108:A81685ABXX:5:1205:20163:89811
#################################################################
```

FIGURE 3.10D

3.11 THOC2_DOCK11

```
108GCCAAT_5    -chrX:122799493_+chrX:117676688    THOC2_DOCK11    fusion_template
****************************************************************
CCATTTTATTTGCAAAAGTGGTGCGCATAGGCAAGTCATTTATGAAGGAG|GAAAAGGCCAAAGTTGTTGAGCCCCTGGACTATGAGAA
TGTTATTGCCCA    junction_-chrX_122799493_+chrX_117676688_NM_010081550_NM_144658
------------GCGCATAGGCAAGTCATTTATGAAGGAG|GAAAGGCCAAAGTTGTTGAG------
    SEQUENCER02:108:A81685ABXX:5:1108:10015:185826
#################################################################
```

FIGURE 3.11A

```
108GCCAAT_5         -chrX:122799493_+chrX:117676688    THOC2_DOCK11   donor_template
*****************************************************************************************************
CCATTTATTTGCAAAAGTGGTGCGCCATAGGCAAGTCATTTATGAAGGAG|TTTCAGTCTGATGGAAGCAAACAAGAAGATAAAGAAAA
AACGGAAGTTAT junction -chrX_122799493_-chrX_122779226_NM_001081550
----GTGGTGCGCCATAGGCAAGTCATTTATGAAGGAG|TTTCAGTCTGATGGAAG-----------
     SEQUENCER02:108:A81685ABXX:5:1104:8793:58641
----GGTGCGCCATAGGCAAGTCATTTATGAAGGAG|TTTCAGTCTGATGGAAGCA---------
     SEQUENCER02:108:A81685ABXX:5:1203:15513:84456
----GGTGCGCCATAGGCAAGTCATTTATGAAGGAG|TTTCAGTCTGATGGAAGCA---------
     SEQUENCER02:108:A81685ABXX:5:2201:14283:20971
-------GCGCCATAGGCAAGTCATTTATGAAGGAG|TTTCAGTCTGATGGAAGCAAAC------
     SEQUENCER02:108:A81685ABXX:5:1104:4048:51256
-------GCGCATAGGCAAGTCATTTATGAAGGAG|TTTCAGTCTGATGGAAGCAAAC-------
     SEQUENCER02:108:A81685ABXX:5:1203:2196:80835
-------GCGCATAGGCAAGTCATTTATGAAGGAG|TTTCAGTCTGATGGAAGCAAAC-------
     SEQUENCER02:108:A81685ABXX:5:2107:1936:175114
-------GCGCATAGGCAAGTCATTTATGAAGGAG|TTTCAGTCTGATGGAAGCAAAC-------
     SEQUENCER02:108:A81685ABXX:5:2205:19396:174943
---------GCATAGGCAAGTCATTTATGAAGGAG|TTTCAGTCTGATGGAAGCAAACAA-----
     SEQUENCER02:108:A81685ABXX:5:2203:20571:86173
------------CATAGGCAAGTCATTTATGAAGGAG|TTTCAGTCTGATGGAAGCAAACAAG---
     SEQUENCER02:108:A81685ABXX:5:1207:13484:54546
-----------TAGGCAAGTCATTTATGAAGGAG|TTTCAGTCTGATGGAAGCAAACAAGAA----
     SEQUENCER02:108:A81685ABXX:5:1108:18224:132466
-------------TAGGCAAGTCATTTATGAAGGAG|TTTCAGTCTGATGGAAGCAAACAAGAA--
     SEQUENCER02:108:A81685ABXX:5:2203:12327:173134
-------------AGGCAAGTCATTTATGAAGGAG|TTTCAGTCTGATGGAAGCAAACAAGAAG--
     SEQUENCER02:108:A81685ABXX:5:1101:11232:158863
-------------AGGCAAGTCATTTATGAAGGAG|TTTCAGTCTGATGGAAGCAAACAAGAAG--
     SEQUENCER02:108:A81685ABXX:5:1102:2581:146277
-------------AGGCAAGTCATTTATGAAGGAG|TTTCAGTCTGATGGAAGCAAACAAGAAG--
     SEQUENCER02:108:A81685ABXX:5:1108:12327:90789
```

FIGURE 3.11B

```
------------------------------------------------AGGCAAGTCATTTATGAAGGAG|TTTCAGTCTGATGGAAGCAAACAAGAAG-------------------
                 SEQUENCER02:108:A81685ABXX:5:1208:9397:195687
------------------------------------------------AGGCAAGTCATTTATGAAGGAG|TTTCAGTCTGATGGAAGCAAACAAGAAG-------------------
                 SEQUENCER02:108:A81685ABXX:5:2104:3692:35070
------------------------------------------------AGGCAAGTCATTTATGAAGGAG|TTTCAGTCTGATGGAAGCAAACAAGAAG-------------------
                 SEQUENCER02:108:A81685ABXX:5:2105:16147:82186
------------------------------------------------AGGCAAGTCATTTATGAAGGAG|TTTCAGTCTGATGGAAGCAAACAAGAAG-------------------
                 SEQUENCER02:108:A81685ABXX:5:2207:17578:43240
################################################################################################################
108GCCAAT_5      -chrX:122799493_+chrX:117676688    THOC2_DOCK11   acceptor_template
*************************************************************************************************************
CTGAGCTCCGCAGAGCGTGTCTGAGGCCGTGCGGGGCTCCGTGGTGCTG|GAAAAGGCCAAAGTTGTTGAGCCCCTGGACTATGAGAA
TGTTATTGCCCA  junction_+chrX_117630036_+chrX_117676688_NM_144658
################################################################################################################
108GCCAAT_5      -chrX:122799493_+chrX:117676688    THOC2_DOCK11   donor_genomic_template
*************************************************************************************************************
CCATTTTATTTGCAAAAGTGGTGCGCATAGGCAAGTCATTTATGAAGGAG|GTAAGTAAGATTTTCTTACAAACCTAAATTTTGAAAT
GAAAATATTCTG  junction_-chrX_122799493_NM_001081550   THOC2_DOCK11
################################################################################################################
108GCCAAT_5      -chrX:122799493_+chrX:117676688    THOC2_DOCK11   
   acceptor_genomic_template
*************************************************************************************************************
TAACTCTCTGTGAGTTTGATCATAATAACTTTACTTTTGTCTCTTATAAAG|GAAAAGGCCAAAGTTGTTGAGCCCCTGGACTATGAGAA
TGTTATTGCCCA  junction_+chrX_117676688_NM_144658
################################################################################################################
```

FIGURE 3.11C

3.12 FGD5_BTC

```
108GCCAAT_6       +chr3:14960340_-chr4:75673359 FGD5_BTC   fusion_template
********************************************************************************

TACGCTCTAAAGATTGAGACTTCCGAGTCCTGCCTGATGCTGTCTGCGAG|CCCTCTTCGGAAACGTCGTAAAAGAAGAAAGAAG
AAGAAATGGAAA     junction_+chr3_14960340_-chr4_75673359 NM_152536 NM_001729
                                ---GCCTGATGCTGTCTGCGAG|CCCTCTTCGGAAACGTCGTAAAAGAAAGAAG---------
             SEQUENCER02:108:A81685ABXX:6:1107:7656:66305
                                ---GCCTGATGCTGTCTGCGAG|CCCTCTTCGGAAACGTCGTAAAAGAAAGAAG---------
             SEQUENCER02:108:A81685ABXX:6:2202:11224:55583
                                ---GCCTGATGCTGTCTGCGAG|CCCTCTTCGGAAACGTAAAAGAAAGAAG------------
             SEQUENCER02:108:A81685ABXX:6:2202:9797:129623
                                ---GCCTGATGCTGTCTGCGAG|CCCTCTTCGGAAACGTCGTAAAAGAAAGAAG---------
             SEQUENCER02:108:A81685ABXX:6:2208:6080:26484
##################################################################################

108GCCAAT_6       +chr3:14960340_-chr4:75673359 FGD5_BTC   donor_template
********************************************************************************

TACGCTCTAAAGATTGAGACTTCCGAGTCCTGCCTGATGCTGTCTGCGAG|CTCCTGTGCAGAGAGGACGAGTGGTATGGCTGTGA
GCAGAGCCCTCC     junction_+chr3_14960340_+chr3_14963425 NM_152536
##################################################################################

108GCCAAT_6       +chr3:14960340_-chr4:75673359 FGD5_BTC   acceptor_template
********************************************************************************

GTTATGGTAGTTTTTATTATTTTGGTCATCGGTGTCTGCACATGCTGTCA|CCCTCTTCGGAAACGTCGTAAAAGAAGAAAGAAG
AAGAAATGGAAA     junction_-chr4_75675783_-chr4_75673359 NM_001729
##################################################################################

108GCCAAT_6       +chr3:14960340_-chr4:75673359 FGD5_BTC   donor_genomic_template
```

FIGURE 3.12A

```
***********************************************************************************
***********
TACGCTCTAAAGATTGAGACTTCCGAGTCCTGCCTGATGCTGTCTGCGAG|GTACGGGCAGGTGGAGGGAGGATGGCGCACAAGGCAGA
GGTGTGAGCATG    junction_+chr3_14960340_NM_152536
##################################################################################
##########
108GCCAAT_6      +chr3:14960340_-chr4:75673359_FGD5_BTC    acceptor_genomic_template
***********************************************************************************
***********
TTCGCATGAACTACTAGGCCCATACTAACTTCTAACACGTATTTCCAAG|CCCTCTTCGGAAACGTCGTAAAAGAAAGAAGAAAGAAG
AAGAAATGGAAA    junction_-chr4_75673359_NM_001729
##################################################################################
##########

FIGURE 3.12B 3.13 RPS28_LOC100505619
108TTAGGC_2      +chr19:8386587_-chr16:52118478    RPS28_LOC100505619  fusion_template
***********************************************************************************
***********
GGGTCACCAAGGTCCTGGGCAGGACCGGTTCTCAGGGACAGTGCACGCAG|GGTTCTTCTGCTCACTGGGTCAGAAGCATCCGATTTCC
TGTCATCGGTTG    junction_+chr19_8386587_-chr16_52118478_NM_001031_NR_038233
***********************************************************************************
----GGGCAGGACCGGTTCTCAGGGACAGTGCACGCAG|GGTTCTTCTGCTCACT-------
    SEQUENCER02:108:A81685ABXX:2:2106:9674:126510
-----------------AGGGACAGTGCACGCAG|GGTTCTTCTGCTCACCGGGTCAGAAGCATCCGA----
    SEQUENCER02:108:A81685ABXX:2:2107:11252:177287
##################################################################################
##########
108TTAGGC_2      +chr19:8386587_-chr16:52118478    RPS28_LOC100505619  donor_template
***********************************************************************************
***********
GGGTCACCAAGGTCCTGGGCAGGACCGGTTCTCAGGGACCTTCAGGGACAGTGCACGCAG|GTGCGCGTGAATTCATGGACGACGAGCCGATCCAT
CATCCGCAATGT    junction_+chr19_8386587_+chr19_8386837_NM_001031

```
3.14 TANC2_RDM1
108TTAGGC_4   +chr17:61086987_-chr17:34247276   TANC2_RDM1   fusion_template
***************************************************************************
***************
CAAGATGCTGCTTACTGGTGGGAAATCAAGTCGTAAAAACAGGTCAAGTG|AAAGTGGTAAAATAGCTGTGGAGTACAGAGACCCAGTGAA
GACATCGTAGGT   junction_+chr17_61086987_-chr17_34247276_chr17:34247276_NM_025185_NM_145654
-------TACTGGTGGGAAATCAAGTCGTAAAAACAGGTCAAGTG|AAAGTGGTAAAA-----------------------------
------------ SEQUENCER02:108:A81685ABXX:4:1207:7633:100208
-------TACTGGTGGGAAATCAAGTCGTAAAAACAGGTCAAGTG|AAAGTGGTAAAA-----------------------------
------------ SEQUENCER02:108:A81685ABXX:4:2203:9112:66020
-------TACTGGTGGGAAATCAAGTCGTAAAAACAGGTCAAGTG|AAAGTGGTAAAA-----------------------------
------------ SEQUENCER02:108:A81685ABXX:4:2206:16489:112661
----------GGTGGGAAATCAAGTCGTAAAAACAGGTCAAGTG|AAAGTGGTAAAATAGC------------------------
------------ SEQUENCER02:108:A81685ABXX:4:2102:14038:94673
-----------GGTGGGAAATCAAGTCGTAAAAACAGGTCAAGTG|AAAGTGGTAAAATAGCTGT---------------------
------------ SEQUENCER02:108:A81685ABXX:4:2107:5396:84793
############################################################################
###############
108TTAGGC_4   +chr17:61086987_-chr17:34247276   TANC2_RDM1   donor_template
***************************************************************************
***************
CAAGATGCTGCTTACTGGTGGGAAATCAAGTCGTAAAAACAGGTCAAGTG|ATGGAGGAGCGAGGAGGAACCACCGGATCGAAGACAGTCA
AGTGTAGACTCT   junction_+chr17_61086987_-chr17_34247276_chr17_61151304_NM_025185
-------GGTGGGAAATCAAGTCGTAAAAACAGGTCAAGTG|ATGGAGGAGCGAGGA-----------------------------
------------ SEQUENCER02:108:A81685ABXX:4:1204:20172:67761
-------GGTGGGAAATCAAGTCGTAAAAACAGGTCAAGTG|ATGGAGGAGCGAGGA-----------------------------
------------ SEQUENCER02:108:A81685ABXX:4:2107:5581:154890
-------GGTGGGAAATCAAGTCGTAAAAACAGGTCAAGTG|ATGGAGGAGCGAGGA-----------------------------
------------ SEQUENCER02:108:A81685ABXX:4:2108:8045:47448
-------GGTGGGAAATCAAGTCGTAAAAACAGGTCAAGTG|ATGGAGGAGCGAGGA-----------------------------
------------ SEQUENCER02:108:A81685ABXX:4:2208:10862:150784
-------TGGGAAATCAAGTCGTAAAAACAGGTCAAGTG|ATGGAGGAGCGAGGAA----------------------------
------------ SEQUENCER02:108:A81685ABXX:4:1101:8972:34070
```

```
-----GGGAAATCAAGTCGTAAAAACAGGTCAAGTG|GTAAGTGACTATGCTACAT-------
     SEQUENCER02:108:A81685ABXX:4:1208:6692:64981
-----GGGAAATCAAGTCGTAAAAACAGGTCAAGTG|GTAAGTGACTATGCTACAT-------
     SEQUENCER02:108:A81685ABXX:4:2106:19050:11709
-----GGGAAATCAAGTCGTAAAAACAGGTCAAGTG|GTAAGTGACTATGCTACAT-------
     SEQUENCER02:108:A81685ABXX:4:2205:13978:25851
-----GGGAAATCAAGTCGTAAAAACAGGTCAAGTG|GTAAGTGACTATGCTACAT-------
     SEQUENCER02:108:A81685ABXX:4:2206:16496:180711
###################################################################
108TTAGGC_4    +chr17:61086987_-chr17:34247276    TANC2_RDM1
       acceptor_genomic_template
*******************************************************************
GTTTTAGAATGAATGAAAAGATTCTGAATTGATCCTCGCTAACTTTATTTCAG|AAAAGTGGTAAAATAGCTGTGGAGTACAGACCCAGTGAA
GACATCGTAGGT    junction_-chr17_34247276_NM_145654
-----                      -CGCTAACTTTATTTCAG|AAAAGTGGTAAAATAGCTGTGGAGTACAGACCCA-------
            SEQUENCER02:108:A81685ABXX:4:1105:4261:53824
###################################################################
```

FIGURE 3.14C

3.15 DDX5_IQCG
```
108TTAGGC_4    -chr17:62496667_-chr3:197640913    DDX5_IQCG fusion_template
*******************************************************************
TCAAGCAATTAATCCCAAGTTGCTTCAGTTGGTCGAAGACAGAGGTTCAG|AGTCAGAATGAGTATATTGCTAACCTCAAGGACCAACT
GCAAGAGATGAA    junction_-chr17_62496667_-chr3_197640913_NM_004396_NM_032263
-----   CAAGTTGCTTCAGTTGGTCGAAGACAGAGGTTCAG|AGTCAGAATGAGTAT-------
            SEQUENCER02:108:A81685ABXX:4:1203:9820:66033
-----   CAAGTTGCTTCAGTTGGTCGAAGACAGAGGTTCAG|AGTCAGAATGAGTAT-------
            SEQUENCER02:108:A81685ABXX:4:1207:19857:115708
```

FIGURE 3.15A

```
                         ------------CAGTTGGTCGAAGACAGAGGTTCAG|AGTCAGAATGAGTATATTGCTAACC-----
                         SEQUENCER02:108:A81685ABXX:4:1106:15344:165510
                         ------------CAGTTGGTCGAAGACAGAGGTTCAG|AGTCAGAATGAGTATATTGCTAACC-----
                         SEQUENCER02:108:A81685ABXX:4:1206:11311:128796
                         ------------CAGTTGGTCGAAGACAGAGGTTCAG|AGTCAGAATGAGTATATTGCTAACC-----
                         SEQUENCER02:108:A81685ABXX:4:2107:7732:180123
                         ---------CGAAGACAGAGGTTCAG|AGTCAGAATGAGTATATTGCTAACCTCAAGGAC----
                         SEQUENCER02:108:A81685ABXX:4:2101:4307:191863
                         ---------CGAAGACAGAGGTTCAG|AGTCAGAATGAGTATATTGCTAACCTCAAGGAC----
                         SEQUENCER02:108:A81685ABXX:4:2103:17875:13611
                         ---------CGAAGACAGAGGTTCAG|AGTCAGAATGAGTATATTGCTAACCTCAAGGAC----
                         SEQUENCER02:108:A81685ABXX:4:2105:8514:171073
                         ---------CGAAGACAGAGGTTCAG|AGTCAGAATGAGTATATTGCTAACCTCAAGGAC----
                         SEQUENCER02:108:A81685ABXX:4:2201:16049:73892
                         ---------CGAAGACAGAGGTTCAG|AGTCAGAATGAGTATATTGCTAACCTCAAGG------
                         SEQUENCER02:108:A81685ABXX:4:2203:13777:157368
                         ---------CGAAGACAGAGGTTCAG|AGTCAGAATGAGTATATTGCTAACCTCAAGGAC----
                         SEQUENCER02:108:A81685ABXX:4:2204:15442:53658
CAGAGGTTCAG|AGTCAGAATGAGTATATTGCTAACCTCAAGGACCAACT-----------------
       SEQUENCER02:108:A81685ABXX:4:2104:17418:108384
CAGAGGTTCAG|AGTCAGAATGAGTATATTGCTAACCTCAAGGACCAACT-----------------
       SEQUENCER02:108:A81685ABXX:4:2108:10522:49288
AGAGGTTCAG|AGTCAGAATGAGTATATTGCTAACCTCAAGGACCAACTGC----------------
      SEQUENCER02:108:A81685ABXX:4:2102:12848:107967
AGAGGTTCAG|AGTCAGAATGAGTATATTGCTAACCTCAAGGACCAACTGC----------------
      SEQUENCER02:108:A81685ABXX:4:2103:21201:111501
###########################################################################
108TTAGGC_4  -chr17:62496667_-chr3:197640913    DDX5_IQCG donor_template
###########################################################################
```

TCAAGCAATTAATCCCAAGTTGCTTCAGTTGGTCGAAGACAGAGGTTCAG|GTCGTTCCAGGGTAGAGAGGAGGCATGAAGGATGACCGT
CGGGACAGATAC     junction_-chr17_62496667_-chr17_62496444_NM_004396
           -AAGTTGCTTCAGTTGGTCGAAGACAGAGGTTCAG|GTCGTTCCAGGGTAG-------------------------------
             SEQUENCER02:108:A81685ABXX:4:1105:6497:83826
           -AAGTTGCTTCAGTTGGTCGAAGACAGAGGTTCAG|GTCGTTCCAGGGTAG-------------------------------
             SEQUENCER02:108:A81685ABXX:4:2108:3490:1050049
           -AAGTTGCTTCAGTTGGTCGAAGACAGAGGTTCAG|GTCGTTCCAGGGTAG-------------------------------
             SEQUENCER02:108:A81685ABXX:4:2205:10640:15348
           ---TTCAGTTGGTCGAAGACAGAGGTTCAG|GTCGTTCCAGGGTAGAGAGGC---------------------------
             SEQUENCER02:108:A81685ABXX:4:2107:7441:6100
           ---TTCAGTTGGTCGAAGACAGAGGTTCAG|GTCGTTCCAGGGTAGAGAGGAGGC------------------------
             SEQUENCER02:108:A81685ABXX:4:2203:4020:139384
           ----CAGTTGGTCGAAGACAGAGGTTCAG|GTCGTTCCAGGGTAGAGAGGAGGCAT----------------------
             SEQUENCER02:108:A81685ABXX:4:1203:7324:91181
           ----CAGTTGGTCGAAGACAGAGGTTCAG|GTCGTTCCAGGGTAGAGAGGAGGCAT----------------------
             SEQUENCER02:108:A81685ABXX:4:2204:10336:78005
           ------CGAAGACAGAGGTTCAG|GTCGTTCCAGGGTAGAGAGGAGGCATGAAGGATG-----------------
             SEQUENCER02:108:A81685ABXX:4:2206:11568:143228
           --------GACAGAGGTTCAG|GTCGTTCCAGGGTAGAGAGGAGGTATGAAGGATGACCG-
             SEQUENCER02:108:A81685ABXX:4:2206:8523:38648

CAGAGGTTCAG|GTCGTTCCAGGGTAGAGAGGAGGCATGAAGGATGACCGT---
   SEQUENCER02:108:A81685ABXX:4:1104:16808:121651
CAGAGGTTCAG|GTCGTTCCAGGGTAGAGAGGAGGCATGAAGGATGACCGTC---
   SEQUENCER02:108:A81685ABXX:4:1105:3472:94252
CAGAGGTTCAG|GTCGTTCCAGGGTAGAGAGGAGGCATGAAGGATGACCGTC---
   SEQUENCER02:108:A81685ABXX:4:2201:5566:67061
```

```
                                         -TTGGTCGAAGACAGAGGTTCAG|GTAAGGATGATTGATAGGAAATGTTGGT---------
                         SEQUENCER02:108:A81685ABXX:4:2207:12236:72840
                                         TTGGTCGAAGACAGAGGTTCAG|GTAAGGATGACTGATAGGAAATGTTGGT---------
                         SEQUENCER02:108:A81685ABXX:4:1207:5776:151413
                                      AAGACAGAGGTTCAG|GTAAGGATGACTGATAGGAAATGTTGGTAGTTACG---
                         SEQUENCER02:108:A81685ABXX:4:2102:4892:12303
                                           GACAGAGGTTCAG|GTAAGGATGACTGATAGGAAATGTTGGTAGTTACGAG-
                         SEQUENCER02:108:A81685ABXX:4:1205:8257:145031
                                           -GACAGAGGTTCAG|GTAAGGATGACTGATAGGAAATGTTGGTAGTTACGAG-
                         SEQUENCER02:108:A81685ABXX:4:2105:1901:162779

ACAGAGGTTCAG|GTAAGGATGACTGATAGGAAATGTTGGTAGTTACGAGT------------
    SEQUENCER02:108:A81685ABXX:4:1103:14098:169873
ACAGAGGTTCAG|GTAAGGATGACTGATAGGAAATGTTGGTAGTTACGAGT------------
    SEQUENCER02:108:A81685ABXX:4:1103:8028:131579
ACAGAGGTTCAG|GTAAGGATGACTGATAGGAAATGTTGGTAGTTACGAGT------------
    SEQUENCER02:108:A81685ABXX:4:1202:20253:79979
ACAGAGGTTCAG|GTAAGGATGACTGATAGGAAATGTTGGTAGTTACGAGT------------
    SEQUENCER02:108:A81685ABXX:4:1205:16689:12401
ACAGAGGTTCAG|GTAAGGATGACTGATAGGAAATGTTGGTAGTTACGAGT------------
    SEQUENCER02:108:A81685ABXX:4:2107:2794:52937
AGGTTCAG|GTAAGGATGACTGATAGGAAATGTTGGTAGTTACGAGTCACA----
    SEQUENCER02:108:A81685ABXX:4:2106:12969:181987
AGGTTCAG|GTAAGGATGACTGATAGGAAATGTTGGTAGTTACGAGTCACA----
    SEQUENCER02:108:A81685ABXX:4:2203:7864:161057
```

FIGURE 3.15E

```
AGGTTCAG|GTAAGGATGACTGATAGGAAATGTTGGTAGTTACGAGTCACA------
        SEQUENCER02:108:A81685ABXX:4:2207:8752:32055
------
GGTTCAG|GTAAGGATGACTGATAGGAAATGTTGGTAGTTACGAGTCACAT-----
        SEQUENCER02:108:A81685ABXX:4:1102:6216:99322
------
GGTTCAG|GTAAGGATGACTGATAGGAAATGTTGGTAGTTACGAGTCACAT-----
        SEQUENCER02:108:A81685ABXX:4:2106:12413:176379
#################################################################
108TTAGGC_4    -chr17:62496667_-chr3:197640913    DDX5_IQCG acceptor_genomic_template
*****************************************************************
ATGGAGGTAGAATGTATTTTCAATTTAGAAACCTGGTCTTTCCACTACAG|AGTCAGAATGAGTATATTGCTAACCTCAAGGACCAACT
GCAAGAGATGAA  junction_-chr3_197640913_NM_032263
####################################################
#########
```

FIGURE 3.15F

3.16 EIF4A3_TSPEAR
```
108TTAGGC_4    -chr17:78120592_-chr21:45953806    EIF4A3_TSPEAR  fusion_template
*****************************************************************
CGACACCATGGGCCTGCGCGGGAGGACCTGCTGCGGGCATCGCGCTTACG|AGGAACGAGTACCTGCTGACGGTGGTGCAGAGAGAG
CGACCTGCTGCT  junction_-chr17_78120592_-chr21_45953806_NM_014740_NM_144991
------------CGGGGCATCGCGCTTACGCTTACG|AGGAACGAGTACCTGCTGACGGTGGTGGCA---------------
        SEQUENCER02:108:A81685ABXX:4:1205:10089:152425
############################################################
108TTAGGC_4    -chr17:78120592_-chr21:45953806    EIF4A3_TSPEAR  donor_template
*****************************************************************
CGACACCATGGGCCTGCGCGGGAGGACCTGCTGCGGGCATCGCGCTTACG|GTTTTGAAAAACCATCAGCAATCCAGCAACGAGCAATC
```

3.17 VDAC3_IL1RAPL1

```
108TTAGGC_6       +chr8:42256382_+chrX:29301055_VDAC3_IL1RAPL1_fusion_template
****************************************************************************************
AATGGAACACAGACAATACTCTAGGACAGAAATCTCTTGGGAGAATAAG|CCGATGGATGCACTGACTGGTCTATCGATATCAAGAAA
TATCAAGTTTTG    junction_+chr8_42256382_+chrX_29301055_NM_014271
             ----AGGGACAGAAATCTCTTGGGAGAATAAG|CCGATGGATGCACTGACTGGTC-----------------
      SEQUENCER02:108:A81685ABXX:6:1106:1558:34432
             ----AGGGACAGAAATCTCTTGGGAGAATAAG|CCGATGGATGCACTGACTGGTC-----------------
      SEQUENCER02:108:A81685ABXX:6:1107:16262:153207
             ----AGGGACAGAAATCTCTTGGGAGAATAAG|CCGATGGATGCACTGACTGGTC-----------------
      SEQUENCER02:108:A81685ABXX:6:1201:12225:116965
             ----AGGGACAGAAATCTCTTGGGAGAATAAG|CCGATGGATGCACTGACTGGTC-----------------
      SEQUENCER02:108:A81685ABXX:6:2206:20596:96370
             ----AGGGACAGAAATCTCTTGGGAGAATAAG|CCGATGGATGCACTGACTGGTC-----------------
      SEQUENCER02:108:A81685ABXX:6:2208:9094:159611
GGGAGAATAAG|CCGATGGATGCACTGACTGGTCTATCGATATCAAGAAA-----
      SEQUENCER02:108:A81685ABXX:6:1105:6484:18697
GGGAGAATAAG|CCGATGGATGCACTGACTGGTCTATCGATATCAAGAAA-----
      SEQUENCER02:108:A81685ABXX:6:2207:14181:99041
################################################################################
108TTAGGC_6       +chr8:42256382_+chrX:29301055_VDAC3_IL1RAPL1_donor_template
****************************************************************************************
AATGGAACACAGACAATACTCTAGGACAGAAATCTCTTGGGAGAATAAG|TTGGCTGAAGGTTGAAACTGACTCTTGATACCATATT
TGTACCGAACAC    junction_+chr8_42256382_+chr8_42257169_NM_005662
```

FIGURE 3.17A

```
                        -------CTAGGGACAGAAATCTCTTGGGAGAATAAG|TTGGCTGAAGGGTTGAAACT-------------
                        |||||||SEQUENCER02:108:A81685ABXX:6:1103:12634:184490
                        -------CTAGGGACAGAAATCTCTTGGGAGAATAAG|TTGGCTGAAGGGTTGAAACT-------------
                        |||||||SEQUENCER02:108:A81685ABXX:6:1105:9001:77963
                        -------CTAGGGACAGAAATCTCTTGGGAGAATAAG|TTGGCTGAAGGGTTGAAACT-------------
                        |||||||SEQUENCER02:108:A81685ABXX:6:1201:10859:9161
                        -------CTAGGGACAGAAATCTCTTGGGAGAATAAG|TTGGCTGAAGGGTTGAAACT-------------
                        |||||||SEQUENCER02:108:A81685ABXX:6:1205:8516:85364
                        -------CTAGGGACAGAAATCTCTTGGGAGAATAAG|TTGGCTGAAGGGTTGAAACT-------------
                        |||||||SEQUENCER02:108:A81685ABXX:6:2205:14848:162950
                        -------CTAGGGACAGAAATCTCTTGGGAGAATAAG|TTGGCTGAAGGGTTGAAACT-------------
                        |||||||SEQUENCER02:108:A81685ABXX:6:2206:9582:28867
                        ----AGGGACAGAAATCTCTTGGGAGAATAAG|TTGGCTGAAGGGTTGAAACTGA-------------
                        ||||SEQUENCER02:108:A81685ABXX:6:1204:4209:79930
                        ----AGGGACAGAAATCTCTTGGGAGAATAAG|TTGGCTGAAGGGTTGAAACTGA-------------
                        ||||SEQUENCER02:108:A81685ABXX:6:1205:5607:23598
                        -------CTTGGGAGAATAAG|TTGGCTGAAGGGTTGAAACTGAATCTTGATACCATA-
                        |||||||SEQUENCER02:108:A81685ABXX:6:1107:20148:12785
                        -------CTTGGGAGAATAAG|TTGGCTGAAGGGTTGAAACTGAATCTTGATACCATA-
                        |||||||SEQUENCER02:108:A81685ABXX:6:2208:16736:86517
------############################################################################
################****************************************************************
108TTAGGC_6  +chr8:42256382_+chrX:29301055_VDAC3_IL1RAPL1 acceptor_template
****************************************************************************
ATACGCTACTTTTACTCAGAGTTGAAGGTTGTGACCAAAAGAGAGGCTCCG|CCGATGGATGCACTGACTGGTCTATCGATATCAAGAAA
TATCAAGTTTTG junction_+chrX_28807542_+chrX_29301055_NM_014271
################****************************************************************########
108TTAGGC_6  +chr8:42256382_+chrX:29301055_VDAC3_IL1RAPL1 donor_genomic_template
****************************************************************************
```

FIGURE 3.17B

```
AATGGAACACAGACAATACTCTAGGGACAGAAATCTCTTGGGAGAATAAG|GTAAGAGAACGCATTAGAAGTTATTCATAGTTCAATT
TATCTTGTAGAT    junction_+chr8_42256382_NM_005662
------------------------------------------------|------------------------------------
GGGAGAATAAG|GTAAGAGAACGCATTAGAAGTTATTCATAGGTTCAATTT----------------------------------
     SEQUENCER02:108:A81685ABXX:6:1104:10049:177522
#############################################################################
############
108TTAGGC_6    +chr8:42256382_+chrX:29301055_VDAC3_IL1RAPL1_acceptor_genomic_template
*********************************************************************************
********
TTTGCCTCTAATGTTTTTCCTCTCTTTCTCTGTCTCTTTTTTTACGATAG|CCGATGGATGCACTGACTGGTCTATCGATATCAAGAAA
TATCAAGTTTTG    junction_+chrX_29301055_NM_014271
--------------------------------------------------|----------------------------------
############

FIGURE 3.17C 3.18 MED13L_KIF21A
108TTAGGC_8    -chr12:116450602_-chr12:39764063    MED13L_KIF21A_fusion_template
*********************************************************************************
*********
ACTTGGGATTTTGTGGATCCAACCCAAAGAGTCAGCTGTTCTTGTTCCAG|AATAAGACCACAGCTTGCCAAAGAGAAGATTGAAGGAT
GCCATATTTGTA    junction_-chr12_116450602_-chr12_39764063_NM_015335_NM_017641
-----------------------------------------------------------------------------------
---------AACCCAAAGAGTCAGCTGTTCTTGTTCCAG|AATAAGACCACAGCTTGCCA----------------------
     SEQUENCER02:108:A81685ABXX:8:1107:3634:107219
---------AACCCAAAGAGTCAGCTGTTCTTGTTCCAG|AATAAGACCACAGCTTGCCA----------------------
     SEQUENCER02:108:A81685ABXX:8:1108:17904:110631
---------AACCCAAAGAGTCAGCTGTTCTTGTTCCAG|AATAAGACCACAGCTTGCCA----------------------
     SEQUENCER02:108:A81685ABXX:8:2108:7456:140491
#############################################################################
##############
108TTAGGC_8    -chr12:116450602_-chr12:39764063    MED13L_KIF21A_donor_template
*********************************************************************************
***********

FIGURE 3.18A
```

```
ACTTGGGATTTTGTGGATCCAACCCAAAGAGTCAGCTGTTCTTGTTCCAG|GCATAAGCTTTTAAAACGTTGTGCAGTCGGGCCCAATC
GACCTCCCACAG  junction_-chr12_116450602_-chr12_116446937_NM_015335
##############################################################################################
108TTAGGC_8    -chr12:116450602_-chr12:39764063   MED13L_KIF21A  acceptor_template
***********************************************************************************************
GCCAGCATGTTGGGCGCCCCGACGAGAGCTCCGTGCGGGTGGCTGTCAG|AATAAGACCACAGCTTGCCAAAGAGAAGATTGAAGGAT
GCCATATTTGTA  junction_-chr12_39836729_-chr12_39764063_NM_017641
##############################################################################################
108TTAGGC_8    -chr12:116450602_-chr12:39764063   MED13L_KIF21A  donor_genomic_template
***********************************************************************************************
ACTTGGGATTTTGTGGATCCAACCCAAAGAGTCAGCTGTTCTTGTTCCAG|GTAGGTAATAATAAAAGGCAAAATAGTAATGGATCGAAT
GATGGCGCATCT  junction_-chr12_116450602_NM_015335
##############################################################################################
108TTAGGC_8    -chr12:116450602_-chr12:39764063   MED13L_KIF21A
acceptor_genomic_template
***********************************************************************************************
TTTTTTTTGCCATTTATTTTATTTTTCTTTTTCTGATTATTTCTCACAG|AATAAGACCACAGCTTGCCAAAGAGAAGATTGAAGGAT
GCCATATTTGTA  junction_-chr12_39764063_NM_017641
##############################################################################################
```

FIGURE 3.18B

3.19 UTP18_ACACA

```
109GCCAAT_1   +chr17:49354665_-chr17:35487144   UTP18_ACACA  fusion_template
***********************************************************************************************
```

```
***************************************************************************************
*********
AGGTTGAGAATTCTCACTTAATTCTAACAGAGAGCTGGAGCCCTCAACAAA|GTCCTCGGGCGGGAAGTGTACACCTCCAATAACCAGCT
GGGGGCATCCA   junction_-chr17_35506788_-chr17_354871144_NM_198834
-----GAGAATTCTCACTTAATTCTAACAGAGAGCTGGAGCCCTCAACAAA|GTCCT----------------------------
----------################################################################
#########
       SEQUENCER02:109:B815MGABXX:1:2108:9215:151019
109GCCAAT_1   +chr17:49354665_-chr17:35487144   UTP18_ACACA    donor_genomic_template
***********************************************************************************
*********
TGTCTATGACATGCTGGCTGGAAAGTTAATTCCTGTGCATCAAGTGAGAG|GTAAGATTTCTGTTGAATGCACAACCAGTCATTCCC
CCCAAGTGAGT   junction_+chr17_49354665_NM_016001
############################################################################
#########
109GCCAAT_1   +chr17:49354665_-chr17:35487144   UTP18_ACACA
  acceptor_genomic_template
***********************************************************************************
*****
GCCTTTATTCTATAGAGACAAATGTCTTTCTCTTGCTCTTTTCTCTAG|GTCCTCGGGCGGGAAGTGTACACCTCCAATAACCAGCT
GGGGGCATCCA   junction_-chr17_35487144_NM_198834
###############################################################################
###
```

FIGURE 3.19C

3.20 ATRX_RPS6KA6
```
109GCCAAT_2   -chrX:76907604_-chrX:83419395 ATRX_RPS6KA6   fusion_template
*****************
GACGAAAACGTATTGCTGAGAGGGAGCGTGAGCGGAGAAAATTGAGAGAG|GTAAATGGTCTTAAAATGGTTGATGAGCCAATGGAAGA
GGGAGAAGCGAGA   junction_-chrX_76907604_-chrX_83419395_NM_000489_NM_014496
*****************
-----GAGGGAGCGTGAGCGAGAAAATTGAGAGAG|GTAAATGGTCTTAAAATGG----------
       SEQUENCER02:109:B815MGABXX:2:1202:14389:188450
```

```
------------------------------------CGTGAGCGAGAAAAATTGAGAGAG|GTAACTAATTTCTTCTTCTTTTTT-------
        SEQUENCER02:109:B815MGABXX:2:1104:11417:145248
################################################################################
109GCCAAT_2   -chrX:76907604_-chrX:83419395 ATRX_RPS6KA6   acceptor_genomic_template
********************************************************************************
ACTCTTGTTTTAATACTTTTGAACCTCAATTTTGAACAATGTTTTTCAG|GTAAATGGTCTTAAAATGGTTGATGAGCCAATGGAAGA
GGGAAGCAGA  junction_-chrX_83419395_NM_014496
################################################################################
###############
```

FIGURE 3.20C

3.21 GOPC_TRMT11

```
109GCCAAT_5  -chr6:117923167_+chr6:1263598511    GOPC_TRMT11    fusion_template
********************************************************************************
*********
AGCTTTGCCACAAAGCCCAGTCTGTGTCTCAAATCAACCACAAGCTGGAG|AATCGGACCAGTATTCACATCTGCTAAGTGATCATTT
TCTGCCATACCA  junction_-chr6_117923167_+chr6_126359851_NM_020399_NM_001031712
--------------TGTGTCTCAAATCAACCACAAGCTGGAG|AATCGGACCAGTATTCACAT----------
         SEQUENCER02:109:B815MGABXX:5:1206:15821:113935
################################################################################
###############
109GCCAAT_5  -chr6:117923167_+chr6:126359851    GOPC_TRMT11    donor_template
********************************************************************************
******
AGCTTTGCCACAAAGCCCAGTCTGTGTCTCAAATCAACCACAAGCTGGAG|GCACAGTTGGTGGATCTGAAATCTGAACTGACAGAAAC
CCAAGCAGAGAA  junction_-chr6_117923167_-chr6_117900227_NM_020399
################################################################################
#####################
109GCCAAT_5  -chr6:117923167_+chr6:126359851    GOPC_TRMT11    acceptor_template
********************************************************************************
***********
```

FIGURE 3.21A

```
GTCACACACATCAAGGCGCTTGATCACAATGGAAAAGGTGAAGAAATTTGAG|AATCGGGACCAGTATTCACATCTGCTAAGTGATCATTT
TCTGCCATACCA   junction_+chr6_126342426_+chr6_126359851_NM_001031712
################################################################################################
109GCCAAT_5    -chr6:117923167_+chr6:126359851    GOPC_TRMT11   donor_genomic_template
*******************************************************************************************

AGCTTTGCCACAAAGCCCAGTCTGTCTCAAATCAACCACAAGCTGGAG|GTGAGCCGTGGGTGCTGGCGGCTATGGCATCCAACCCC
AGGCTGCCCCGT   junction_-chr6_117923167_NM_020399
################################################################################################
109GCCAAT_5    -chr6:117923167_+chr6:126359851    GOPC_TRMT11
################################################################################################
               acceptor_genomic_template
*******************************************************************************************

AAGCTAAACTAAAGAAATAATTTTTACATTTGTATTTCCAACCAAACAG|AATCGGGACCAGTATTCACATCTGCTAAGTGATCATTT
TCTGCCATACCA   junction_+chr6_126359851_NM_001031712
################################################################################################
```

FIGURE 3.21B

```
3.22 PREX1_SLC9A8
109TTTAGGC_2   -chr20:47324798_+chr20:48431545    PREX1_SLC9A8   fusion_template
*******************************************************************************************
AGAAGCTGGAAGCCCTGGAGCAGCTGCAGTCCCACATCGAAGGCTGGGAG|GAGGTTCCCCAATACAACTCATGAGGGTTTCAATGTCA
CCCTCCACACCA   junction_-chr20_47324798_+chr20_48431545_NM_020820_NM_015266
--------------GGAAGCCCTGGAGCAGCTGCAGTCCCACATCGAAGGCTGGGAG|GAGGTTC---------------------
               SEQUENCER02:109:B815MGABXX:2:1104:15007:118719
--------------GGAAGCCCTGGAGCAGCTGCAGTCCCACATCGAAGGCTGGGAG|GAGGTTC---------------------
               SEQUENCER02:109:B815MGABXX:2:2104:4073:86174
--------------GGAAGCCCTGGAGCAGCTGCAGTCCCACATCGAAGGCTGGGAG|GAGGTTC---------------------
               SEQUENCER02:109:B815MGABXX:2:2204:15268:122863
```

FIGURE 3.22A

```
                                                      ------GGAAGCCCTGGAGCAGCTGCAGTCCCACATCGAAGGCTGGGAG|GAGGTTC----------------
                                                            SEQUENCER02:109:B815MGABXX:2:2204:15308:121858
                                                   ---CCCTGGAGCAGCTGCAGTCCCACATCGAAGGCTGGGAG|GAGGTTCCCCAA-----------------
                                                      SEQUENCER02:109:B815MGABXX:2:2206:6608:95902
                                                ---GGAGCAGCTGCAGTCCCACATCGAAGGCTGGGAG|GAGGTTCCCCAATACA---------------
                                                   SEQUENCER02:109:B815MGABXX:2:1201:3198:19210
                                             ------GCAGCTGCAGTCCCACATCGAAGGCTGGGAG|GAGGTTCCCCAATACAACT-------------
                                                   SEQUENCER02:109:B815MGABXX:2:2103:14193:154722
                                             ------GCAGCTGCAGTCCCACATCGAAGGCTGGGAG|GAGGTTCCCCAATACAACT-------------
                                                   SEQUENCER02:109:B815MGABXX:2:2106:5574:37670
                                             ------GCAGTCCCACATCGAAGGCTGGGAG|GAGGTTCCCCAATACAACTCATGAG-------------
                                                   SEQUENCER02:109:B815MGABXX:2:1107:14593:66159
                                             ------GCAGTCCCACATCGAAGGCTGGGAG|GAGGTTCCCCAATACAACTCATGAG-------------
                                                   SEQUENCER02:109:B815MGABXX:2:1205:6358:82724
                                             ------GCAGTCCCACATCGAAGGCTGGGAG|GAGGTTCCCCAATACAACTCATGAG-------------
                                                   SEQUENCER02:109:B815MGABXX:2:1207:10918:9826
                                             ---------GCAGTCCCACATCGAAGGCTGGGAG|GAGGTTCCCCAATACAACTCATGAG----------
                                                      SEQUENCER02:109:B815MGABXX:2:2205:14690:73929
                                             ------------CGAAGGCTGGGAG|GAGGTTCCCCAATACAACTCATGAGGGTTTCAATGTC-
                                                         SEQUENCER02:109:B815MGABXX:2:2208:11388:106182
AAGGCTGGGAG|GAGGTTCCCCAATACAACTCATGAGGGTTTCAATGTCAC---------
           SEQUENCER02:109:B815MGABXX:2:1203:2636:9298
AAGGCTGGGAG|GAGGTTCCCCAATACAACTCATGAGGGTTTCAATGTCAC---------
           SEQUENCER02:109:B815MGABXX:2:2208:13751:192169
CTGGGAG|GAGGTTCCCCAATACAACTCATGAGGGTTTCAATGTCACCCTC---
       SEQUENCER02:109:B815MGABXX:2:2108:13201:21136
GGGAG|GAGGTTCCCCAATACAACTCATGAGGGTTTCAATGTCACCCTCCA-----
     SEQUENCER02:109:B815MGABXX:2:1202:1033:9653
```

```
-----------------------------------------------------------------------------
AAGGCTGGGAG|GGTTCCAACCTCACAGACATCTGCACTCAGCTCCTCCTG-----------------------
          SEQUENCER02:109:B815MGABXX:2:1201:8324:43786
-----------------------------------------------------------------------------
AAGGCTGGGAG|GGTTCCAACCTCACAGACATCTGCACTCAGCTCCTCCTG-----------------------
          SEQUENCER02:109:B815MGABXX:2:2102:20248:52533
-----------------------------------------------------------------------------
AAGGCTGGGAG|GGTTCCAACCTCACAGACATCTGCACTCAGCTCCTCCTG-----------------------
          SEQUENCER02:109:B815MGABXX:2:2102:5040:48823
-----------------------------------------------------------------------------
AAGGCTGGGAG|GGTTCCAACCTCACAGACATCTGCACTCAGCTCCTCCTG-----------------------
          SEQUENCER02:109:B815MGABXX:2:2203:19009:189651
-----------------------------------------------------------------------------
AAGGCTGGGAG|GGTTCCAACCTCACAGACATCTGCACTCAGCTCCTCCTG-----------------------
          SEQUENCER02:109:B815MGABXX:2:2205:3651:191797
-----------------------------------------------------------------------------
AGGCTGGGAG|GGTTCCAACCTCACAGACATCTGCACTCAGCTCCTCCTGC-----------------------
          SEQUENCER02:109:B815MGABXX:2:1102:15562:152265
-----------------------------------------------------------------------------
AGGCTGGGAG|GGTTCCAACCTCACAGACATCTGCACTCAGCTCCTCCTGC-----------------------
          SEQUENCER02:109:B815MGABXX:2:1104:8808:8875
-----------------------------------------------------------------------------
AGGCTGGGAG|GGTTCCAACCTCACAGACATCTGCACTCAGCTCCTCCTGC-----------------------
          SEQUENCER02:109:B815MGABXX:2:1208:15287:101044
-----------------------------------------------------------------------------
AGGCTGGGAG|GGTTCCAACCTCACAGACATCTGCACTCAGCTCCTCCTGC-----------------------
          SEQUENCER02:109:B815MGABXX:2:2201:8106:192084
-----------------------------------------------------------------------------
AGGCTGGGAG|GGTTCCAACCTTCACAGACATCTGCACTCAGCTCCTCCTGC----------------------
          SEQUENCER02:109:B815MGABXX:2:2204:1756:156603
-----------------------------------------------------------------------------
AGGCTGGGAG|GGTTCCAACCTCACAGACATCTGCACTCAGCTCCTCCTGC-----------------------
          SEQUENCER02:109:B815MGABXX:2:2205:3495:122190
```

FIGURE 3.22D

```
AGGCTGGGAG|GGTTCCAACCTCACAGACATCTGCACTCAGCTCCTCCTGC----------
SEQUENCER02:109:B815MGABXX:2:2208:17311:78448

AGGCTGGGAG|GGTTCCAACCTCACAGACATCTGCACTCAGCTCCTCCTGC----------
SEQUENCER02:109:B815MGABXX:2:2208:9709:51716

GGCTGGGAAG|GGTTCCAACCTCACAGACATCTGCACTCAGCTCCTCCTGCA---------
SEQUENCER02:109:B815MGABXX:2:2104:12446:170527

GCTGGGAAG|GGTTCCAACCTCACAGACATCTGCACTGCACTCAGCTCCTCCTGCAA-----
SEQUENCER02:109:B815MGABXX:2:1103:14424:171347

GCTGGGAAG|GGTTCCAACCTCACAGACATCTGCACTCAGCTCCTCCTGCAA---------
SEQUENCER02:109:B815MGABXX:2:1103:17211:46007

GCTGGGAAG|GGTTCCAACCTCACAGACAGCTGCACTCAGCTCCTCCTGCAA---------
SEQUENCER02:109:B815MGABXX:2:1103:4187:169526

GCTGGGAAG|GGTTCCAACCTCACAGACATCTGCACTCAGCTCCTCCTGCAA---------
SEQUENCER02:109:B815MGABXX:2:1201:1564:146249

GCTGGGAAG|GGTTCCAACCTCACAGACATCTGCACTCAGCTCCTCCTGCAA---------
SEQUENCER02:109:B815MGABXX:2:1203:20374:155387

GCTGGGAAG|GGTTCCAACCTCACAGACATCTGCACTCAGCTCCTCCTGCAA---------
SEQUENCER02:109:B815MGABXX:2:1205:19497:28830

GCTGGGAAG|GGTTCCAACCTCACAGACATCTGCACTTCTCCTGCAA--------------
SEQUENCER02:109:B815MGABXX:2:2204:8578:84867

GCTGGGAAG|GGTTCCAACCTCACAGACATCTGCACTTCTCCTGCAA--------------
SEQUENCER02:109:B815MGABXX:2:2205:15512:168160
```

FIGURE 3.22E

```
GCTGGGAG|GGTTCCAACCTCACAGACATCTGCACTCAGCTCCTCCTGCAA-----
         SEQUENCER02:109:B815MGABXX:2:2207:2017:21600
TGGGAG|GGTTCCAACCTCACAGACATCTGCACTCAGCTCCTCCTGCAAGG-----
         SEQUENCER02:109:B815MGABXX:2:2204:1490:16914
TGGGAG|GGTTCCAACCTCACAGACATCTGCACTCAGCTCCTCCTGCAAGG-----
         SEQUENCER02:109:B815MGABXX:2:2206:8730:98641
GGGAG|GGTTCCAACCTCACAGACATCTGCACTCAGCTCCTCCTGCAAGG-----
         SEQUENCER02:109:B815MGABXX:2:1101:19489:63476
GGGAG|GGTTCCAACCTCACAGACATCTGTACTCAGCTCCTCCTGCAAGG-----
         SEQUENCER02:109:B815MGABXX:2:1101:9736:32320
GGGAG|GGTTCCAACCTCACAGACATCTGCACTCAGCTCCTCCTGCAAGG-----
         SEQUENCER02:109:B815MGABXX:2:2104:15766:34377
GGGAG|GGTTCCAACCTCACAGACATCTGCACTCAGCTCCTCCTGCAAGG-----
         SEQUENCER02:109:B815MGABXX:2:2204:16589:6623
GGGAG|GGTTCCAACCTCACAGACATCTGCACTCAGCTCCTCCTGCAAGG-----
         SEQUENCER02:109:B815MGABXX:2:2206:11879:148278
GGGAG|GGTTCCAACCTCACAGACATCTGCACTCAGCTCCTCCTGCAAGG-----
         SEQUENCER02:109:B815MGABXX:2:2208:10158:128354
GGGAG|GGTTCCAACCTCACAGACATCTGCACTCAGCTCCTCCTGCAAGG-----
         SEQUENCER02:109:B815MGABXX:2:2208:4413:42317
###############################################################
##########
109TTAGGC_2   -chr20:47324798_+chr20:48431545   PREX1_SLC9A8   acceptor_template
```

FIGURE 3.22F

```
******************************************************************************
*********
CGGTGGTCCTGGAAGCTCCGCAGGATGGGGAGAAGATGGGCGGAGAGAGGA|GAGGTTCCCCAATACAACTCATGAGGGTTTCAATGTCA
CCCTCCACACCA   junction_+chr20_48429485_+chr20_48431545_NM_015266
################################################################################
109TTAGGC_2   -chr20:47324798_+chr20:48431545   PREX1_SLC9A8   donor_genomic_template
******************************************************************************
**********
AGAAGCTGGAAGCCCTGGAGCAGCAGCTGCAGTCCCACATCGAAGGCTGGGAG|GTGTGTACAGGACAGGAGGGGCTTCCTGGGCCGCAGG
GGGCCAGGAGGT   junction_-chr20_47324798_NM_020820
---------------------------
GGGAG|GTGTGTACAGGACAGGAGGGGCCTTTCTGGGCCGCAGGGGCCAG-----
   SEQUENCER02:109:B815MGABXX:2:1104:14929:49259
################################################################################
109TTAGGC_2   -chr20:47324798_+chr20:48431545   PREX1_SLC9A8
   acceptor_genomic_template
******************************************************************************
***********
TGTTTTGGGACCCTTTTCCATTATCTAATTATGCTTTCTATGTCCTCCAG|GAGGTTCCCCAATACAACTCATGAGGGTTTCAATGTCA
CCCTCCACACCA   junction_+chr20_48431545_NM_015266
################################################################################
```

FIGURE 3.22G

```
3.23 RIMS2_DPYS
109TTAGGC_2   +chr8:104709524_-chr8:105436617   RIMS2_DPYS   fusion_template
******************************************************************************
*************
CAAAGTTCTGTGTGCTCGTTGTGGAGGTCGAGTGTCATTACGCTCAAACAAG|CATAGTGGTAAAATGGATGAAAACAGATTTGTGGCAGT
TACCAGCACAAA   junction_+chr8_104709524_-chr8_105436617_NM_001100117_NM_001385
```

```
*********************************************************************
*********
CAAAGTTCTCGTGCTCGTTGTGGAGTCGAGTGTCATTACGCTCAAACAAG|GTACAGAAATGAAAATTACAGTTCTCTTCTAGTTAAGC
TTATTGTGTTTA   junction_+chr8_104709524_-chr8_104510017  NM_001100117
#############################################################################
109TTAGGC_2   +chr8:104709524_-chr8:105436617      RIMS2_DPYS
       acceptor_genomic_template
*****************************************************************************
ATACTTTTAGTATTTGATCATTAGAATGATTCTTTGAATTGCTTTACAG|CATAGTGGTAAAATGGATGAAAACAGATTTGTGGCAGT
TACCAGCACAAA   junction_-chr8_105436617_NM_001385
#############################################################################

FIGURE 3.23C 3.24 PQLC1_LINC00330
109TTAGGC_5   -chr18:77710724_-chr13:45379166     PQLC1_LINC00330      fusion_template
*****************************************************************************
TACGTGTGCCTGGTGCTGGTGGCCAACATTTGCGGATACTCTTCTG|AGTCTTGCTCTCGTCGCCCAGGCTGGAGTGCAGTGGTGC
GACCTTGGGCTCA   junction_-chr18_77710724_-chr13_45379166_NM_025078_NR_038433
----------------GCTGGTGGCCAACATTTGCGGATACTCTTCTG|AGTCTTGCTCTGTCGCC--------------
            SEQUENCER02:109:B815MGABXX:5:2103:7304:91208
#############################################################################
109TTAGGC_5   -chr18:77710724_-chr13:45379166     PQLC1_LINC00330      donor_template
*****************************************************************************
TACGTGTGCCTGGTGCTGGTGGCCAACATTTGCGGATACTCTTCTG|GTTTGGAAGGCGCTTTGAGTCCCGCTGCTGTGGCAGA
GCGCCATCATGA   junction_-chr18_77710724_-chr18_77703462_NM_025078
#############################################################################

```
CAAAGGCCAAGGCTTTTCAGGTTACATGTAATTTTATGTAAATCTTACAG|GTGAATATGAGAAGGGCGTAGACCATCTGACAAATGCA
ATTGCTGTGTGT   junction -chr1_235277225 NM_014765
################################################################################
##############
```

FIGURE 3.25C

```
3.26 ADK_C10orf11
110GCCAAT_2    +chr10:75984349_+chr10:77795766    ADK_C10orf11   fusion_template
************************************************************************************
TCTCTGAAACCAAATGACCAAATCTTGGCTGAAGACAAACACAAGGAACT|GTCACTGGAAGGACTGAGCGCATTCAGGAGCCTGGAGG
AACTCATCTCTTGG  junction +chr10_75984349_+chr10_77795766_NM_001123 NM_032024
-----------TGGCTGAAGACAAACACAAGGAACT|GTCACTGGAAGGACTGAGCGCATTC--------
              SEQUENCER02:110:A815YFABXX:2:2208:6887:21776
-----------GGCTGAAGACAAACACAAGGAACT|GTCACTGGAAGGACTGAGCGCAT-----------
              SEQUENCER02:110:A815YFABXX:2:1107:16505:83929
-------------CTGAAGACAAACACAAGGAACT|GTCACTGGAAGGACTGAGCGCATTCAG--------
              SEQUENCER02:110:A815YFABXX:2:1203:18592:194495
-------------CTGAAGACAAACACAAGGAACT|GTCACTGGAAGGACTGAGCGCATTCAG--------
              SEQUENCER02:110:A815YFABXX:2:1207:4426:93082
-------------CTGAAGACAAACACAAGGAACT|GTCACTGGAAGGACTGAGCGCATTCAG--------
              SEQUENCER02:110:A815YFABXX:2:2101:14119:197769
-------------CTGAAGACAAACACAAGGAACT|GTCACTGGAAGGACTGAGCGCATTCAG--------
              SEQUENCER02:110:A815YFABXX:2:2203:5413:177727
################################################################################
###########
110GCCAAT_2    +chr10:75984349_+chr10:77795766    ADK_C10orf11   donor_template
************************************************************************************
TCTCTGAAACCAAATGACCAAATCTTGGCTGAAGACAAACACAAGGAACT|GTTTGATGAACTTGTGAAAAATTCAAAGTCGAATATC
ATGCTGGTGGCT  junction +chr10_75984349_+chr10_76074425_NM_001123
-----------TGGCTGAAGACAAACACAAGGAACT|GTTTGATGAACTTGTGAAAAATTC-----------
              SEQUENCER02:110:A815YFABXX:2:1107:5481:165095
```

FIGURE 3.26A

```
-----------------------------TGGCTGAAGACAAACACAAGGAACT|GTTTGATGAACTTGTGAAAAAATTC-----    SEQUENCER02:110:A815YFABXX:2:1108:6920:88765
-----------------------------TGGCTGAAGACAAACACAAGGAACT|GTTTGATGAACTTGTGAAAAAATTC-----    SEQUENCER02:110:A815YFABXX:2:1201:10468:57051
-----------------------------TGGCTGAAGACAAACACAAGGAACT|GTTTGATGAACTTGTGAAAAAATTC-----    SEQUENCER02:110:A815YFABXX:2:2105:15412:5495
-----------------------------TGGCTGAAGACAAACACAAGGAACT|GTTTGATGAACTTGTGAAAAAATTC-----    SEQUENCER02:110:A815YFABXX:2:2202:2719:18028
-----------------------------TGGCTGAAGACAAACACAAGGAACT|GTTTGATGAACTTGTGAAAAAATTC-----    SEQUENCER02:110:A815YFABXX:2:2204:11705:196481
-----------------------------TGGCTGAAGACAAACACAAGGAACT|GTTTGATGAACTTGTGAAAAAATTC-----    SEQUENCER02:110:A815YFABXX:2:2204:9661:197329
AAGGAACT|GTTTGATGAACTTGTGAAAAAATTCAAAGTCGAATATCATGC----------    SEQUENCER02:110:A815YFABXX:2:1108:20881:10162
AAGGAACT|GTTTGATGAACTTGTGAAAAAATTCAAAGTCGAATATCATGC----------    SEQUENCER02:110:A815YFABXX:2:1207:6392:189840
################################################################################
110GCCAAT_2    +chr10:75984349_+chr10:77795766    ADK_C10orf11    acceptor_template
****************************************************************************
TGAATGGAAAAGTATTTGTCACTCAGCGGCAATCATTCTTCAAATAAAAG|GTCACTGGAAGGACTGAGCGCATTCAGGAGCCTGGAGG
AACTCATCTTGG    junction_+chr10_77542780_+chr10_77795766_NM_032024
################################################################################
110GCCAAT_2    +chr10:75984349_+chr10:77795766    ADK_C10orf11    donor_genomic_template
****************************************************************************
TCTCTGAAACCAAATGACCAAATCTTGGCTGAAGACAAACACAAGGAACT|GTAAGTGCATTAAACCATTGGTTGTAAATAGTTTACTC
TGTCTATGAACT    junction_+chr10_75984349_NM_001123
```

FIGURE 3.26B

```
##############################################################################
###########
110GCCAAT_2     +chr10:75984349_+chr10:77795766    ADK_C10orf11
             acceptor_genomic_template
****************************************************************************
***********
CTCCCTGATTTAGTGCAGGATCATTTTCCTGTTGCCTTTGTCATTGCAG|GTCACTGGAAGGACTGAGCGCATTCAGGAGCCTGGAGG
AACTCATCTTGG    junction_+chr10_77795766_NM_032024
############################################################################
###########
```

FIGURE 3.26C

3.27 DMKN_LGI4
```
110GCCAAT_4     -chr19:35989618_-chr19:35617921    DMKN_LGI4 fusion_template
****************************************************************************
************
CGGCTTCCCGGGGTGCAACCTGGCCTGCTGCAGTGGGTGAAGTTTTGGTAG|AGCTGTCCTGGTTCCAGACGGTGGGGAGTCGGCACTG
AGCGTAGAGCCC    junction_-chr19_35989618_-chr19_35617921_NM_033317_NM_139284
------------GGCCTGCTGCAGTGGGTGAAGTTTTGGTAG|AGCTGTCCTGGTTCCAGACG-----------
--------    SEQUENCER02:110:A815YFABXX:4:1103:9241:82908
############################################################################
###########
110GCCAAT_4     -chr19:35989618_-chr19:35617921    DMKN_LGI4 donor_template
****************************************************************************
************
CGGCTTCCCGGGGTGCAACCTGGCCTGCTGCAGTGGGTGAAGTTTTGGTAG|GCAATTTCTTGCAACCACCGAGGCCCCGAAAAGCA
CTGGTCGTCAGG    junction_-chr19_35989618_-chr19_35988440_NM_033317
############################################################################
###########
110GCCAAT_4     -chr19:35989618_-chr19:35617921    DMKN_LGI4 acceptor_template
****************************************************************************
************
```

FIGURE 3.27A

```
CATGCAGCTCCACCACCTGACCCCAAGACTTTCAAGTGCAGAGCCATAG|AGCTGTCCTGGTTCCAGACGGTGGGGAGTCGGCACTG
AGCGTAGAGCCC    junction -chr19_35622290_-chr19_35617921_NM_139284
##########################################################################################
110GCCAAT_4       -chr19:35989618_-chr19:35617921    DMKN_LGI4_donor_genomic_template
**********************************************************************

AGGCTTCCCCGGGTGCAACCTGGCCTGCTCGCAGTGGGTGAAGTTTTGGTAG|GTGAGTGTCAGAGTGAGCCACCCAGGCCACATCCTGG
CAGTGGAGGCAC    junction -chr19_35989618_NM_033317
##########################################################################################
110GCCAAT_4       -chr19:35989618_-chr19:35617921    DMKN_LGI4_acceptor_genomic_template
**********************************************************************

GAGGACCCTGGGGGTCCTGGGCCTGCCTGACTCTCTTCTCCACCCACAG|AGCTGTCCTGGTTCCAGACGGTGGGGAGTCGGCACTG
AGCGTAGAGCCC    junction -chr19_35617921_NM_139284
##########################################################################################
```

FIGURE 3.27B

3.28 ZNF569_SHFM1
```
110GCCAAT_4      -chr19:37956215_-chr7:96324203    ZNF569_SHFM1    fusion_template
**********************************************************************
CCCCTACTATCATGTACTTACATTTTTGTGGGCTGGATAATAAACAAG|ACTGGGCTGGCTTAGATGAAGATGAAGATGCACATGTC
TGGGAGGATAAT    junction -chr19_37956215_-chr7_96324203_NM_152484_NM_006304
----------------GTGGGCTGGATAATAAACAAG|ACTGGGCTGGCTTAGATGAAGATGAAGATGAAGAT------
          SEQUENCER02:110:A815YFABXX:4:1106:8760:88675
----------------GTGGGCTGGATAATAAACAAG|ACTGGGCTGGCTTAGATGAAGATGAAGATGAAGAT------
          SEQUENCER02:110:A815YFABXX:4:2106:6755:11924
----------------GTGGGCTGGATAATAAACAAG|ACTGGGCTGGCTTAGATGAAGATGAAGATGAAGAT------
          SEQUENCER02:110:A815YFABXX:4:2205:4998:125775
```

FIGURE 3.28A

```
##############################################################################
##############
110GCCAAT_4      -chr19:37956215_-chr7:96324203     ZNF569_SHFM1    donor_template
****************************************************************************
************
CCCCTACTACTATCATGGTACTTACATTTTTGTGGGCTGGATAATAAACAAG|CTCTACTTCTGCAGGCCCATCCCTTCCCAGAAAGAAG
AGGAAATGACTG   junction_-chr19_37956215_-chr19_37935866_NM_152484
-------------------GTGGGCTGGATAATAAACAAG|CTCTACTTCTGCAGGCCCATCCCTTCCC---------
                   SEQUENCER02:110:A815YFABXX:4:1204:18420:141943
-------------------TGGGCTGGATAATAAACAAG|CTCTACTTCTGCAGGCCCATCCCTTCCCA--------
                   SEQUENCER02:110:A815YFABXX:4:1202:5982:158620
##############################################################################
##############
110GCCAAT_4      -chr19:37956215_-chr7:96324203     ZNF569_SHFM1    acceptor_template
****************************************************************************
************
CTTAGTCTCTGTTAGAGGAAGACGACGAGTTTGAAGAGTTCCCTGCCGAAG|ACTGGGCTGGCTTAGATGAAGATGAAGATGCACATGTC
TGGGAGGATAAT   junction_-chr7_96339000_-chr7_96324203_NM_006304
----------------GAGGAAGACGACGAGTTTGAAGAGTTCCCTGCCGAAG|ACTGGGCTGGCTT----------
                   SEQUENCER02:110:A815YFABXX:4:1101:5022:65525
----------------GAGGAAGACGACGAGTTTGAAGAGTTCCCTGCCGAAG|ACTGGGCTGGCTT----------
                   SEQUENCER02:110:A815YFABXX:4:2108:10160:159403
----------------GAGGAAGACGACGAGTTTGAAGAGTTCCCTGCCGAAG|ACTGGGCTGGCTT----------
                   SEQUENCER02:110:A815YFABXX:4:2206:18241:56021
----------------GACGAGTTTGAAGAGTTCCCTGCCGAAG|ACTGGGCTGGCTTAGATGAAGA---------
                   SEQUENCER02:110:A815YFABXX:4:2206:5909:84762
----------------GACGAGTTTGAAGAGTTCCCTGCCGAAG|ACTGGGCTGGCTTAGATGAAGA---------
                   SEQUENCER02:110:A815YFABXX:4:2208:10252:152577
##############################################################################
##############
110GCCAAT_4      -chr19:37956215_-chr7:96324203     ZNF569_SHFM1    donor_genomic_template
****************************************************************************
************
```

FIGURE 3.28B

```
CCCCCTACTACTCATGGTACTTACATTTTTGTGGGCTGGATAATAAACAAG|GTAAGTAAATTAAGTATGAAGTATTTTAAATGGTGAAG
AATACTAAGAAA    junction_-chr19_37956215_NM_152484
------------------TGGGCTGGATAATAAACAAG|GTAAGTAAATTAAGTATGAAGTATTTTAAA----------------------
           SEQUENCER02:110:A815YFABXX:4:1201:5036:98826
------------------TGGGCTGGATAATAAACAAG|GTAAGTAAATTAAGTATGAAGTATTTTAAA----------------------
           SEQUENCER02:110:A815YFABXX:4:1203:15447:12813
------------------TGGGCTGGATAATAAACAAG|GTAAGTAAATTAAGTATGAAGTATTTTAAA----------------------
           SEQUENCER02:110:A815YFABXX:4:1203:20552:105100
------------------TGGGCTGGATAATAAACAAG|GTAAGTAAATTAAGTATGAAGTATTTTAAA----------------------
           SEQUENCER02:110:A815YFABXX:4:1546:63444
------------------TGGGCTGGATAATAAACAAG|GTAAGTAAATTAAGTATGAAGTATTTTAAA----------------------
           SEQUENCER02:110:A815YFABXX:4:2105:1546:63444
------------------TGGGCTGGATAATAAACAAG|GTAAGTAAATTAAGTATGAAGTATTTTAAA----------------------
           SEQUENCER02:110:A815YFABXX:4:2207:6393:120736
-------------------GGGCTGGATAAACAAG|GTAAGTAAATTAAGTATGAAGTATTTTAAAT---------------------
           SEQUENCER02:110:A815YFABXX:4:1105:17811:157505
-------------------GGGCTGGATAATAAACAAG|GTAAGTAAATTAAGTATGAAGTATTTTAAAT---------------------
           SEQUENCER02:110:A815YFABXX:4:1206:19027:13076
-------------------GGGCTGGATAATAAACAAG|GTAAGTAAATTAAGTATGAAGTATTTTAAAT---------------------
           SEQUENCER02:110:A815YFABXX:4:1206:8425:158019
-------------------GGGCTGGATAATAAACAAG|GTAAGTAAATTAAGTATGAAGTATTTTAAAT---------------------
           SEQUENCER02:110:A815YFABXX:4:2101:14342:152132
-------------------GGGCTGGATAATAAACAAG|GTAAGTAAATTAAGTATGAAGTATTTTAAAT---------------------
           SEQUENCER02:110:A815YFABXX:4:2207:9043:195729
###############################################################################################
###########
110GCCAAT_4  -chr19:37956215_-chr7:96324203    ZNF569_SHFM1
            acceptor_genomic_template
*****************
TGGAAATAATGTATGAGAAATATTAGACAGCATCTGTTTCTATTTTTAG|ACTGGGCTGGCTTAGATGAAGATGAAGATGCCACATGTC
TGGGAGGATAAT    junction_-chr7_96324203_NM_006304
###############################################################################################
###########
```

FIGURE 3.28C 3.29 APP_C21orf7

```
110GCCAAT_4       -chr21:27326904_+chr21:30547033       APP_C21orf7      fusion_template
*************************************************************************************
CCTGCTCTACAACGTGCCTGCAGTGGCCGAGGAGATTCAGGATGAAGTTG|GAAGGAGCTCATTGCCAAGTTAGATCAGGCAGAAAAGG
AGAAGGTGGATG      junction_-chr21_27326904_+chr21_30547033_NM_020152
-----------------------------------------------------GCAGTGGCCGAGGAGATTCAGGATGAAGTTG|GAAGGAGCTCATTGCCAAG---
              SEQUENCER02:110:A815YFABXX:4:1202:19593:31073
##############################################################################
#####     ********************
110GCCAAT_4       -chr21:27326904_+chr21:30547033       APP_C21orf7      donor_template
*************************************************************************************
CCTGCTCTACAACGTGCCTGCAGTGGCCGAGGAGATTCAGGATGAAGTTG|ATGAGCTGCTTCAGAAAGAGCAAAACTATTCAGATGAC
GTCTTGGCCAAC     junction_-chr21_27284274_NM_000484
--------------------GCAGTGGCCGAGGAGATTCAGGATGAAGTTG|ATGAGCTGCTTCAGAAAGA---
              SEQUENCER02:110:A815YFABXX:4:1104:19686:119590
--------------------GCAGTGGCCGAGGAGATTCAGGATGAAGTTG|ATGAGCTGCTTCAGAAAGA---
              SEQUENCER02:110:A815YFABXX:4:1105:11470:26630
--------------------GCAGTGGCCGAGGAGATTCAGGATGAAGTTG|ATGAGCTGCTTCAGAAAGA---
              SEQUENCER02:110:A815YFABXX:4:1106:12224:159984
--------------------GCAGTGGCCGAGGAGATTCAGGATGAAGTTG|ATGAGCTGCTTCAGAAAGA---
              SEQUENCER02:110:A815YFABXX:4:1106:15202:68823
--------------------GCAGTGGCCGAGGAGATTCAGGATGAAGTTG|ATGAGCTGCTTCAGAAAGA---
              SEQUENCER02:110:A815YFABXX:4:1106:3340:10005
--------------------GCAGTGGCCGAGGAGATTCAGGATGAAGTTG|ATGAGCTGCTTCAGAAAGA---
              SEQUENCER02:110:A815YFABXX:4:1107:18966:33381
--------------------GCAGTGGCCGAGGAGATTCAGGATGAAGTTG|ATGAGCTGCTTCAGAAAGA---
              SEQUENCER02:110:A815YFABXX:4:1204:8809:79740
--------------------GCAGTGGCCGAGGAGATTCAGGATGAAGTTG|ATGAGCTGCTTCAGAAAGA---
              SEQUENCER02:110:A815YFABXX:4:2102:13108:90600
```

FIGURE 3.29A

```
------GCAGTGGCCGAGGAGATTCAGGATGAAGTTG|ATGAGCTGCTTCAGAAAGA------- SEQUENCER02:110:A815YFABXX:4:2104:2279:73018
------GCAGTGGCCGAGGAGATTCAGGATGAAGTTG|ATGAGCTGCTTCAGAAAGA------- SEQUENCER02:110:A815YFABXX:4:2104:6325:39358
------GCAGTGGCCGAGGAGATTCAGGATGAAGTTG|ATGAGCTGCTTCAGAAAGA------- SEQUENCER02:110:A815YFABXX:4:2105:6082:47753
------GCAGTGGCCGAGGAGATTCAGGATGAAGTTG|ATGAGCTGCTTCAGAAAGA------- SEQUENCER02:110:A815YFABXX:4:2107:20976:157020
------GCAGTGGCCGAGGAGATTCAGGATGAAGTTG|ATGAGCTGCTTCAGAAAGA------- SEQUENCER02:110:A815YFABXX:4:2202:11472:137572
------GCAGTGGCCGAGGAGATTCAGGATGAAGTTG|ATGAGCTGCTTCAGAAAGA------- SEQUENCER02:110:A815YFABXX:4:2203:18718:52095
------GCAGTGGCCGAGGAGATTCAGGATGAAGTTG|ATGAGCTGCTTCAGAAAGA------- SEQUENCER02:110:A815YFABXX:4:2206:21091:8041
------GCAGTGGCCGAGGAGATTCAGGATGAAGTTG|ATGAGCTGCTTCAGAAAGA------- SEQUENCER02:110:A815YFABXX:4:2208:6224:130282
-----CAGTGGCCGAGGAGATTCAGGATGAAGTTG|ATGAGCTGCTTCAGAAAGAG------ SEQUENCER02:110:A815YFABXX:4:1101:16730:126846
-----CAGTGGCCGAGGAGATTCAGGATGAAGTTG|ATGAGCTGCTTCAGAAAGAG------ SEQUENCER02:110:A815YFABXX:4:1104:7970:172766
-----CAGTGGCCGAGGAGATTCAGGATGAAGTTG|ATGAGCTGCTTCAGAAAGAG------ SEQUENCER02:110:A815YFABXX:4:1108:15176:146592
-----CAGTGGCCGAGGAGATTCAGGATGAAGTTG|ATGAGCTGCTTCAGAAAGAG------ SEQUENCER02:110:A815YFABXX:4:1201:19926:128128
-----CAGTGGCCGAGGAGATTCAGGATGAAGTTG|ATGAGCTGCTTCAGAAAGAG------ SEQUENCER02:110:A815YFABXX:4:2102:11125:102389
----CAGTGGCCGAGGAGATTCAGGATGAAGTTG|ATGAGCTGCTTCAGAAAGAG------- SEQUENCER02:110:A815YFABXX:4:2104:7760:29055
----CAGTGGCCGAGGAGATTCAGGATGAAGTTG|ATGAGCTGCTTTAGAAAGAG------- SEQUENCER02:110:A815YFABXX:4:2105:1539:144440
----CAGTGGCCGAGGAGATTCAGGATGAAGTTG|ATGAGCTGCTTCAGAAAGAG------- SEQUENCER02:110:A815YFABXX:4:2105:8096:88544
```

FIGURE 3.29B

```
----------------CAGTGGCCGAGGAGATTCAGGATGAAGTTG|ATGAGCTGCTTCAGAAAGAG----  SEQUENCER02:110:A815YFABXX:4:2107:6687:80697
----------------CAGTGGCCGAGGAGATTCAGGATGAAGTTG|ATGAGCTGCTTCAGAAAGAG----  SEQUENCER02:110:A815YFABXX:4:2204:7467:196422
----------------CAGTGGCCGAGGAGATTCAGGATGAAGTTG|ATGAGCTGCTTCAGAAAGAG----  SEQUENCER02:110:A815YFABXX:4:2206:5421:170122
----------------CAGTGGCCGAGGAGATTCAGGATGAAGTTG|ATGAGCTGCTTCAGAAAGAG----  SEQUENCER02:110:A815YFABXX:4:2206:9394:30753
-------------AGTGGCCGAGGAGATTCAGGATGAAGTTG|ATGAGCTGCTTCAGAAAGAGC---  SEQUENCER02:110:A815YFABXX:4:1101:13111:71006
-------------AGTGGCCGAGGAGATTCAGGATGAAGTTG|ATGAGCTGCTTTAGAAAGAGC---  SEQUENCER02:110:A815YFABXX:4:1101:20812:144991
-------------AGTGGCCGAGGAGATTCAGGATGAAGTTG|ATGAGCTGCTTCAGAAAGAGC---  SEQUENCER02:110:A815YFABXX:4:1103:15621:104190
-------------AGTGGCCGAGGAGATTCAGGATGAAGTTG|ATGAGCTGCTTCAGAAAGAGC---  SEQUENCER02:110:A815YFABXX:4:1104:4236:117582
-------------AGTGGCCGAGGAGATTCAGGATGAAGTTG|ATGAGCTGCTTCAGAAAGAGC---  SEQUENCER02:110:A815YFABXX:4:1107:16394:93297
-------------AGTGGCCGAGGAGATTCAGGATGAAGTTG|ATGAGCTGCTTCAGAAAGAGC---  SEQUENCER02:110:A815YFABXX:4:1107:6283:118827
-------------AGTGGCCGAGGAGATTCAGGATGAAGTTG|ATGAGCTGCTTCAGAAAGAGC---  SEQUENCER02:110:A815YFABXX:4:1107:9406:51140
-------------AGTGGCCGAGGAGATTCAGGATGAAGTTG|ATGAGCTGCTTCAGAAAGAGC---  SEQUENCER02:110:A815YFABXX:4:1201:6115:75041
-------------AGTGGCCGAGGAGATTCAGGATGAAGTTG|ATGAGCTGCTTCAGAAAGAGC---  SEQUENCER02:110:A815YFABXX:4:1202:15550:29781
-------------AGTGGCCGAGGAGATTCAGGATGAAGTTG|ATGAGCTGCTTCAGAAAGAGC---  SEQUENCER02:110:A815YFABXX:4:1202:3431:4291
-------------AGTGGCCGAGGAGATTCAGGATGAAGTTG|ATGAGCTGCTTCAGAAAGAGC---  SEQUENCER02:110:A815YFABXX:4:1208:11925:35303
-------------AGTGGCCGAGGAGATTCAGGATGAAGTTG|ATGAGCTGCTTCAGAAAGAGC---  SEQUENCER02:110:A815YFABXX:4:1208:15586:172413
```

FIGURE 3.29C

```
----------------------AGTGGCCGAGGAGATTCAGGATGAAGTTG|ATGAGCTGCTTCAGAAAGAGC------
------ SEQUENCER02:110:A815YFABXX:4:2101:19946:195846
----------------------AGTGGCCGAGGAGATTCAGGATGAAGTTG|ATGAGCTGCTTCAGAAAGAGC------
------ SEQUENCER02:110:A815YFABXX:4:2102:19087:62079
----------------------AGTGGCCGAGGAGATTCAGGATGAAGTTG|ATGAGCTGCTTCAGAAAGA--------
------ SEQUENCER02:110:A815YFABXX:4:2103:12215:109429
----------------------AGTGGCCGAGGAGATTCAGGATGAAGTTG|ATGAGCTGCTTCAGAAAGAG-------
------ SEQUENCER02:110:A815YFABXX:4:2103:5350:38474
----------------------AGTGGCCGAGGAGATTCAGGATGAAGTTG|ATGAGCTGCTTCAGAAAGAGC------
------ SEQUENCER02:110:A815YFABXX:4:2104:5179:157783
----------------------AGTGGCCGAGGAGATTCAGGATGAAGTTG|ATGAGCTGCTTCAGAAAGAGC------
------ SEQUENCER02:110:A815YFABXX:4:2107:17323:153175
----------------------AGTGGCCGAGGAGATTCAGGATGAAGTTG|ATGAGCTGCTTCAGAAAGAGC------
------ SEQUENCER02:110:A815YFABXX:4:2107:19438:41203
----------------------AGTGGCCGAGGAGATTCAGGATGAAGTTG|ATGAGCTGCTTCAGAAAGAGC------
------ SEQUENCER02:110:A815YFABXX:4:2202:16996:62451
----------------------AGTGGCCGAGGAGATTCAGGATGAAGTTG|ATGAGCTGCTTTAGAAAGAGC------
------ SEQUENCER02:110:A815YFABXX:4:2204:11832:23425
----------------------AGTGGCCGAGGAGATTCAGGATGAAGTTG|ATGAGCTGCTTTAGAAAGAGC------
------ SEQUENCER02:110:A815YFABXX:4:2205:18537:160667
----------------------AGTGGCCGAGGAGATTCAGGATGAAGTTG|ATGAGCTGCTTCAGAAAGAGC------
------ SEQUENCER02:110:A815YFABXX:4:2206:13166:129401
----------------------GTGGCCGAGGAGATTCAGGATGAAGTTG|ATGAGCTGCTTCAGAAAGAGCA------
------ SEQUENCER02:110:A815YFABXX:4:1102:7670:98893
----------------------GTGGCCGAGGAGATTCAGGATGAAGTTG|ATGAGCTGCTTCAGAAAGAGCA------
------ SEQUENCER02:110:A815YFABXX:4:1103:15632:70860
----------------------GTGGCCGAGGAGATTCAGGATGAAGTTG|ATGAGCTGCTTCAGAAAGAGCA------
------ SEQUENCER02:110:A815YFABXX:4:1105:14574:164357
----------------------GTGGCCGAGGAGATTCAGGATGAAGTTG|ATGAGCTGCTTCAGAAAGAGC-------
------ SEQUENCER02:110:A815YFABXX:4:1105:18149:138899
----------------------GTGGCCGAGGAGATTCAGGATGAAGTTG|ATGAGCTGCTTCAGAAAGAGCA------
------ SEQUENCER02:110:A815YFABXX:4:1105:2432:145117
```

FIGURE 3.29D

```
------GTGGCCGAGGAGATTCAGGATGAAGTTG|ATGAGCTGCTTCAGAAAGAGC------
------GTGGCCGAGGAGATTCAGGATGAAGTTG|ATGAGCTGCTTCAGAAAGAGCA-----  SEQUENCER02:110:A815YFABXX:4:1106:1573:92323
------GTGGCCGAGGAGATTCAGGATGAAGTTG|ATGAGCTGCTTCAGAAAGAGCA-----  SEQUENCER02:110:A815YFABXX:4:1107:4366:156474
------GTGGCCGAGGAGATTCAGGATGAAGTTG|ATGAGCTGCTTCAGAAAGAGCA-----  SEQUENCER02:110:A815YFABXX:4:1107:4753:33077
------GTGGCCGAGGAGATTCAGGATGAAGTTG|ATGAGCTGCTTCAGAAAGAGCA-----  SEQUENCER02:110:A815YFABXX:4:1201:4777:55492
------GTGGCCGAGGAGATTCAGGATGAAGTTG|ATGAGCTGCTTCAGAAAGAGCA-----  SEQUENCER02:110:A815YFABXX:4:1202:12754:31194
------GTGGCCGAGGAGATTCAGGATGAAGTTG|ATGAGCTGCTTCAGAAAGAGCA-----  SEQUENCER02:110:A815YFABXX:4:1203:17869:6092
------GTGGCCGAGGAGATTCAGGATGAAGTTG|ATGAGCTGCTTCAGAAAGAGCA-----  SEQUENCER02:110:A815YFABXX:4:1204:1929:120728
------GTGGCCGAGGAGATTCAGGATGAAGTTG|ATGAGCTGCTTCAGAAAGAGCA-----  SEQUENCER02:110:A815YFABXX:4:1205:3601:160993
------GTGGCCGAGGAGATTCAGGATGAAGTTG|ATGAGCTGCTTCAGAAAGAGCA-----  SEQUENCER02:110:A815YFABXX:4:1206:4565:163426
------GTGGCCGAGGAGATTCAGGATGAAGTTG|ATGAGCTGCTTCAGAAAGAG-------  SEQUENCER02:110:A815YFABXX:4:1207:10644:170554
------GTGGCCGAGGAGATTCAGGATGAAGTTG|ATGAGCTGCTTCAGAAAGAGCA-----  SEQUENCER02:110:A815YFABXX:4:1207:10715:16992
------GTGGCCGAGGAGATTCAGGATGAAGTTG|ATGAGCTGCTTCAGAAAGAGCA-----  SEQUENCER02:110:A815YFABXX:4:1207:1537:191936
------GTGGCCGAGGAGATTCAGGATGAAGTTG|ATGAGCTGCTTCAGAAAGAGCA-----  SEQUENCER02:110:A815YFABXX:4:2101:6488:195886
------GTGGCCGAGGAGATTCAGGATGAAGTTG|ATGAGCTGCTTCAGAAAGAGC-------  SEQUENCER02:110:A815YFABXX:4:2102:14711:35071
------GTGGCCGAGGAGATTCAGGATGAAGTTG|ATGAGCTGCTTCAGAAAGAGCA-----  SEQUENCER02:110:A815YFABXX:4:2102:17768:175606
------GTGGCCGAGGAGATTCAGGATGAAGTTG|ATGAGCTGCTTCAGAAAGAGCA-----  SEQUENCER02:110:A815YFABXX:4:2103:11391:23259
```

FIGURE 3.29E

```
--------GTGGCCGAGGAGATTCAGGATGAAGTTG|ATGAGCTGCTTCAGAAAGAG------
    SEQUENCER02:110:A815YFABXX:4:2105:16738:68985
--------GTGGCCGAGGAGATTCAGGATGAAGTTG|ATGAGCTGCTTCAGAAAGAGCA-----
    SEQUENCER02:110:A815YFABXX:4:2105:19128:50630
--------GTGGCCGAGGAGATTCAGGATGAAGTTG|ATGAGCTGCTTCAGAAAGAGCA-----
    SEQUENCER02:110:A815YFABXX:4:2105:20234:139056
--------GTGGCCGAGGAGATTCAGGATGAAGTTG|ATGAGCTGCTTCAGAAAGAGC------
    SEQUENCER02:110:A815YFABXX:4:2105:5923:86303
--------GTGGCCGAGGAGATTCAGGATGAAGTTG|ATGAGCTGCTTCAGAAAGAGC------
    SEQUENCER02:110:A815YFABXX:4:2106:16030:26551
--------GTGGCCGAGGAGATTCAGGATGAAGTTG|ATGAGCTGCTTCAGAAAGAGCA-----
    SEQUENCER02:110:A815YFABXX:4:2203:18638:127740
--------GTGGCCGAGGAGATTCAGGATGAAGTTG|ATGAGCTGCTTCAGAAAGAGC------
    SEQUENCER02:110:A815YFABXX:4:2203:5670:7386
--------GTGGCCGAGGAGATTCAGGATGAAGTTG|ATGAGCTGCTTCAGAAAGAGCA-----
    SEQUENCER02:110:A815YFABXX:4:2204:17412:41930
--------GTGGCCGAGGAGATTCAGGATGAAGTTG|ATGAGCTGCTTCAGAAAGAGC------
    SEQUENCER02:110:A815YFABXX:4:2205:12288:148614
--------GTGGCCGAGGAGATTCAGGATGAAGTTG|ATGAGCTGCTTCAGAAAGAGCA-----
    SEQUENCER02:110:A815YFABXX:4:2205:14596:39835
--------GTGGCCGAGGAGATTCAGGATGAAGTTG|ATGAGCTGCTTCAGAAAGAGC------
    SEQUENCER02:110:A815YFABXX:4:2205:19065:139745
--------GTGGCCGAGGAGATTCAGGATGAAGTTG|ATGAGCTGCTTCAGAAAGAGCA-----
    SEQUENCER02:110:A815YFABXX:4:2207:14004:88934
--------GTGGCCGAGGAGATTCAGGATGAAGTTG|ATGAGCTGCTTCAGAAAGAGCA-----
    SEQUENCER02:110:A815YFABXX:4:2207:18213:2344
--------GTGGCCGAGGAGATTCAGGATGAAGTTG|ATGAGCTGCTTCAGAAAGAGCA-----
    SEQUENCER02:110:A815YFABXX:4:2208:13871:133372
--------GTGGCCGAGGAGATTCAGGATGAAGTTG|ATGAGCTGCTTCAGAAAGAGAC-----
    SEQUENCER02:110:A815YFABXX:4:2208:2832:146628
--------GTGGCCGAGGAGATTCAGGATGAAGTTG|ATGAGCTGCTTCAGAAAGAGC------
    SEQUENCER02:110:A815YFABXX:4:2208:5560:10788
```

FIGURE 3.29F

```
------TGGCCGAGGAGATTCAGGATGAAGTTG|ATGAGCTGCTTCAGAAAGAGCAA------
SEQUENCER02:110:A815YFABXX:4:1103:11080:53483
------TGGCCGAGGAGATTCAGGATGAAGTTG|ATGAGCTGCTTCAGAAAGAGCA--------
SEQUENCER02:110:A815YFABXX:4:1103:17413:16089
------TGGCCGAGGAGATTCAGGATGAAGTTG|ATGAGCTGTTTCAGAAAGAGCAA------
SEQUENCER02:110:A815YFABXX:4:1105:2699:67853
------TGGCCGAGGAGATTCAGGATGAAGTTG|ATGAGCTGCTTCAGAAAGAGCA--------
SEQUENCER02:110:A815YFABXX:4:1105:9908:41258
------TGGCCGAGGAGATTCAGGATGAAGTTG|ATGAGCTGCTTCAGAAAGAG----------
SEQUENCER02:110:A815YFABXX:4:1205:3372:117756
------TGGCCGAGGAGATTCAGGATGAAGTTG|ATGAGCTGCTTCAGAAAGAGCAA------
SEQUENCER02:110:A815YFABXX:4:1207:7049:27597
------TGGCCGAGGAGATTCAGGATGAAGTTG|ATGAGCTGCTTCAGAAAGAGCAA------
SEQUENCER02:110:A815YFABXX:4:1208:16579:194960
------TGGCCGAGGAGATTCAGGATGAAGTTG|ATGAGCTGCTTCAGAAAGAGCAA------
SEQUENCER02:110:A815YFABXX:4:2103:12134:147608
------TGGCCGAGGAGATTCAGGATGAAGTTG|ATGAGCTGCTTCAGAAAGAGCA--------
SEQUENCER02:110:A815YFABXX:4:2103:15981:26812
------TGGCCGAGGAGATTCAGGATGAAGTTG|ATGAGCTGCTTCAGAAAGAGCAA------
SEQUENCER02:110:A815YFABXX:4:2105:20726:188793
------TGGCCGAGGAGATTCAGGATGAAGTTG|ATGAGCTGCTTCAGAAAGAGCAA------
SEQUENCER02:110:A815YFABXX:4:2105:9373:85748
------TGGCCGAGGAGATTCAGGATGAAGTTG|ATGAGCTGCTTCAGAAAGAGCA--------
SEQUENCER02:110:A815YFABXX:4:2106:12233:33986
------TGGCCGAGGAGATTCAGGATGAAGTTG|ATGAGCTGCTTCAGAAAGAGCA--------
SEQUENCER02:110:A815YFABXX:4:2107:14130:15394
------TGGCCGAGGAGATTCAGGATGAAGTTG|ATGAGCTGCTTCAGAAAGAGCAA------
SEQUENCER02:110:A815YFABXX:4:2201:2267:43333
------TGGCCGAGGAGATTCAGGATGAAGTTG|ATGAGCTGTTTCAGAAAGAGCAA------
SEQUENCER02:110:A815YFABXX:4:2202:14507:146564
------TGGCCGAGGAGATTCAGGATGAAGTTG|ATGAGCTGCTTCAGAAAGAGCAA------
SEQUENCER02:110:A815YFABXX:4:2204:17024:153344
```

FIGURE 3.29G

```
----------------------------TGGCCGAGGAGAGATTCAGGATGAAGTTG|ATGAGCTGTTTCAGAAAGAGCAA----------------
------------ SEQUENCER02:110:A815YFABXX:4:2208:12200:11076
----------- GGCCGAGGAGAGATTCAGGATGAAGTTG|ATGAGCTGCTTCAGAAAGAGCAAA---------------
------------ SEQUENCER02:110:A815YFABXX:4:1102:16920:192057
----------- GGCCGAGGAGAGATTCAGGATGAAGTTG|ATGAGCTGCTTCAGAAAGAGCAAA---------------
------------ SEQUENCER02:110:A815YFABXX:4:1102:8739:94809
----------- GGCCGAGGAGAGATTCAGGATGAAGTTG|ATGAGCTGCTTCAGAAAGAGCAAA---------------
------------ SEQUENCER02:110:A815YFABXX:4:1103:10578:172138
----------- GGCCGAGGAGAGATTCAGGATGAAGTTG|ATGAGCTGCTTCAGAAAGAGCAAA---------------
------------ SEQUENCER02:110:A815YFABXX:4:1104:12219:148358
----------- GGCCGAGGAGAGATTCAGGATGAAGTTG|ATGAGCTGCTTCAGAAAGAGCAAA---------------
------------ SEQUENCER02:110:A815YFABXX:4:1105:15274:126630
----------- GGCCGAGGAGAGATTCAGGATGAAGTTG|ATGAGCTGCTTCAGAAAGAGCAAA---------------
------------ SEQUENCER02:110:A815YFABXX:4:1106:17531:111796
----------- GGCCGAGGAGAGATTCAGGATGAAGTTG|ATGAGCTGCTTCAGAAAGAGCAAA---------------
------------ SEQUENCER02:110:A815YFABXX:4:1108:10970:197022
----------- GGCCGAGGAGAGATTCAGGTTGAAGTTG|ATGAGCTGCTTCAGAAAGAGCAAA---------------
------------ SEQUENCER02:110:A815YFABXX:4:1202:3507:74095
----------- GGCCGAGGAGAGATTCAGGATGAAGTTG|ATGAGCTGCTTCAGAAAGAGCAAA---------------
------------ SEQUENCER02:110:A815YFABXX:4:1204:17023:150005
----------- GGCCGAGGAGAGATTCAGGATGAAGTTG|ATGAGCTGCTTCAGAAAGAGCAAA---------------
------------ SEQUENCER02:110:A815YFABXX:4:1206:6192:165509
----------- GGCCGAGGAGAGATTCAGGATGAAGTTG|ATGAGCTGCTTCAGAAAGAGCAAA---------------
------------ SEQUENCER02:110:A815YFABXX:4:1206:6531:180600
----------- GGCCGAGGAGAGATTCAGGATGAAGTTG|ATGAGCTGCTTCAGAAAGAGCAAA---------------
------------ SEQUENCER02:110:A815YFABXX:4:2101:17885:118698
----------- GGCCGAGGAGAGATTCAGGATGAAGTTG|ATGAGCTGCTTCAGAAAGAGCAAA---------------
------------ SEQUENCER02:110:A815YFABXX:4:2101:7940:83181
----------- GGCCGAGGAGAGATTCAGGATGAAGTTG|ATGAGCTGCTTCAGAAAGAGCAAA---------------
------------ SEQUENCER02:110:A815YFABXX:4:2201:5034:108451
----------- GGCCGAGGAGAGATTCAGNATGAAGTTG|ATGAGCTGCTTCAGAAAGAGCAAA---------------
------------ SEQUENCER02:110:A815YFABXX:4:2202:1296:23505
```

FIGURE 3.29H

```
------------------------------GGCCGAGGAGATTCAGGATGAAGTTG|ATGAGCTGCTTCAGAAAGAGCAAA------------------------ SEQUENCER02:110:A815YFABXX:4:2202:14613:178363
------------------------------GGCCGAGGAGATTCAGGATGAAGTTG|ATGAGCTGCTTCAGAAAGAGCAAA------------------------ SEQUENCER02:110:A815YFABXX:4:2202:19764:123486
------------------------------GGCCGAGGAGATTCAGGATGAAGTTG|ATGAGCTGCTTCAGAAAGAGCAAA------------------------ SEQUENCER02:110:A815YFABXX:4:2203:19894:149954
------------------------------GGCCGAGGAGATTCAGGATGAAGTTG|ATGAGCTGCTTCAGAAAGAGCAAA------------------------ SEQUENCER02:110:A815YFABXX:4:2204:20151:61327
------------------------------GGCCGAGGAGATTCAGGATGAAGTTG|ATGAGCTGCTTCAGAAAGAGCAAA------------------------ SEQUENCER02:110:A815YFABXX:4:2204:8640:27677
------------------------------GGCCGAGGAGATTCAGGATGAAGTTG|ATGAGCTGCTTCAGAAAGAGCAAA------------------------ SEQUENCER02:110:A815YFABXX:4:2205:11153:197724
------------------------------GGCCGAGGAGATTCAGGATGAAGTTG|ATGAGCTGCTTCAGAAAGAGCAAA------------------------ SEQUENCER02:110:A815YFABXX:4:2206:11656:40767
------------------------------GGCCGAGGAGATTCAGGATGAAGTTG|ATGAGCTGCTTCAGAAAGAGCAAA------------------------ SEQUENCER02:110:A815YFABXX:4:2206:1347:131752
---------------------------CGAGGAGATTCAGGATGAAGTTG|ATGAGCTGCTTCAGAAAGAGCAAA------------------------ SEQUENCER02:110:A815YFABXX:4:1202:7902:24941
---------------------GAGATTAGGATGAAGTTG|ATGAGCTGCTTCAGAAAGAGCAAAACTATTC------ SEQUENCER02:110:A815YFABXX:4:1105:11288:112503
---------------------GAGATTAGGATGAAGTTG|ATGAGCTGCTTCAGAAAGAGCAAAACTATTC------ SEQUENCER02:110:A815YFABXX:4:2202:14787:110861
------------------ATTCAGGATGAAGTTG|ATGAGCTGCTTCAGAAAGAGCAAAACTATTCAGA--- SEQUENCER02:110:A815YFABXX:4:2104:7719:113785
------------------ATTCAGGATGAAGTTG|ATGAGCTGCTTCAGAAAGAGCAAAACTATTCAGA--- SEQUENCER02:110:A815YFABXX:4:2203:20454:193761
################################################################################
110GCCAAT_4   -chr21:27326904_+chr21:30547033    APP_C21orf7   acceptor_template
********************************************************************************
GAAGAATACCATGAGGTCAAAAAGGAAATCACCCTGCTTGAGCAAAGGAA|GAAGGAGCTCATTGCCAAGTTAGATCAGGCAGAAAAGG
AGAAGGTGGATG   junction_+chr21_30532377_+chr21_30547033_NM_020152
```

FIGURE 3.29I

```
###############################################################################################
###############
110GCCAAT_4      -chr21:27326904_+chr21:30547033    APP_C21orf7    donor_genomic_template
**************************************************************************************************
CCTGCTCTACAACGTGCCTGCAGTGGCCGAGGAGATTCAGGATGAAGTTG|GTAAGTAAGCTGTTCTTTTGATGCTGCACATGGACATG
TATTTTCCCCCA  junction -chr21_273269604 NM_000484
------------CAGTGGCCGAGGAGATTCAGGATGAAGTTG|GTAAGTAAGCTGTTCTTTTG--------------------------
            SEQUENCER02:110:A815YFABXX:4:1103:15289:59181
------------AGTGGCCGAGGAGATTCAGGATGAAGTTG|GTAAGTAAGCTGTTCTTTTGA-------------------------
            SEQUENCER02:110:A815YFABXX:4:1101:17903:51681
------------AGTGGCCGAGGAGATTCAGGATGAAGTTG|GTAAGTAAGCTGTTCTTTTGA-------------------------
            SEQUENCER02:110:A815YFABXX:4:1105:12038:135454
------------AGTGGCCGAGGAGATTCAGGATGAAGTTG|GTAAGTAAGCTGTTCTTTTGA-------------------------
            SEQUENCER02:110:A815YFABXX:4:1107:9307:161470
------------AGTGGCCGAGGAGATTCAGGATGAAGTTG|GTAAGTAAGCTGTTCTTTTGA-------------------------
            SEQUENCER02:110:A815YFABXX:4:1108:10271:151720
------------AGTGGCCGAGGAGATTCAGGATGAAGTTG|GTAAGTAAGCTGTTCTTTTG--------------------------
            SEQUENCER02:110:A815YFABXX:4:1203:4982:36719
------------AGTGGCCGAGGAGATTCAGGATGAAGTTG|GTAAGTAAGCTGTTCTTTTGA-------------------------
            SEQUENCER02:110:A815YFABXX:4:1208:5422:155320
------------AGTGGCCGAGGAGATTCAGGATGAAGTTG|GTAAGTAAGCTGATCTTTTGA-------------------------
            SEQUENCER02:110:A815YFABXX:4:2108:15983:117553
--------TGGCCCGAGGAGATTCAGGATGAAGTTG|GTAAGTAAGCTGTTCTTTTGATG---------------------------
            SEQUENCER02:110:A815YFABXX:4:1102:20503:58692
--------TGGCCCGAGGAGATTCAGGATGAAGTTG|GTAAGTAAGCTGTTCTTTTGATG---------------------------
            SEQUENCER02:110:A815YFABXX:4:1106:9908:108488
--------TGGCCCGAGGAGATTCAGGATGAAGTTG|GTAAGTAAGCTGTTCTTTTGATG---------------------------
            SEQUENCER02:110:A815YFABXX:4:1208:10219:174403
--------TGGCCCGAGGAGATTCAGGATGAAGTTG|GTAAGTAAGCTGTTCTTTTGATG---------------------------
            SEQUENCER02:110:A815YFABXX:4:2106:16910:8381
--------TGGCCCGAGGAGATTCAGGATGAAGTTG|GTAAGTAAGCTGTTCTTTTGATG---------------------------
            SEQUENCER02:110:A815YFABXX:4:2208:12619:164773
```

FIGURE 3.29J

```
-------------------GGCCGAGGAGATTCAGGATGAAGTTG|GTAAGTAAGCTGTGTTCTTTTGATGC----------------
              SEQUENCER02:110:A815YFABXX:4:1201:17668:22574
-------------------GGCCGAGGAGATTCAGGATGAAGTTG|GTAAGTAAGCTGTGTTCTTTTGATGC----------------
              SEQUENCER02:110:A815YFABXX:4:2106:14606:36378
####################################################################################
110GCCAAT_4   -chr21:27326904_+chr21:30547033    APP_C21orf7
   acceptor_genomic_template
*************************************************************************************
GCTTGCATTGAATTCTGTGCTTCTTCCTGCCCTTTACCCCGAATCTTCAG|GAAGGAGCTCATTGCCAAGTTAGATCAGGCAGAAAGG
AGAAGGTGGATG  junction_+chr21_30547033_NM_020152
####################################################################################
##############
```

FIGURE 3.29K

3.30 RAF1_NKIRAS1
```
110GCCAAT_4    -chr3:127053312_-chr3:239942540  RAF1_NKIRAS1   fusion_template
*************************************************************************************
GAGAAGCTGCCGCCGAACGACAGGACGTTGGGGCGGCCTGGCTCCCTCAG|GAATGGAAGATTGCGAAACAATGGAAGATGTATACATG
GCTTCAGTAGAA  junction_-chr3_127053312_-chr3_239942540 NM_002880 NM_020345
-----------------------GGGGCGGCCTGGCTCCCTCAG|GAATGGAAGATTGCGAAACAATGGAAGAT------------
              SEQUENCER02:110:A815YFABXX:4:1207:8893:110366
GGCTCCCTCAG|GAATGGAAGATTGCGAAACAATGGAAGATGTATACATGG-----------------------------------
              SEQUENCER02:110:A815YFABXX:4:1105:14023:142782
GGCTCCCTCAG|GAATGGAAGATTGCGAAACAATGGAAGATGTATACATGG-----------------------------------
              SEQUENCER02:110:A815YFABXX:4:1105:8263:30853
GGCTCCCTCAG|GAATGGAAGATTGCGAAACAATGGAAGATGTATACATGG-----------------------------------
              SEQUENCER02:110:A815YFABXX:4:1202:11548:116462
```

FIGURE 3.30A

```
GGCTCCCTCAG|GAATGGAAGATTGCGAAACAATGGAAGATGTATACATGG------------
          SEQUENCER02:110:A815YFABXX:4:1204:5035:58862
          ------
GGCTCCCTCAG|GAATGGAAGATTGCGAAACAATGGAAGATGTATACATGG------------
          SEQUENCER02:110:A815YFABXX:4:2204:5543:134561
###########################################################################
##########
110GCCAAT_4     -chr3:127053127 -chr3:23942540 RAF1_NKIRAS1_donor_template
***********************************************************************
GAGAAGCTGCCGCCGAACGACAGGACGTTGGGGCGGCCTGGCTCCCTCAG|GTTTAAGAATTGTTTAAGCTGCATCAATGGAGCACATA
CAGGGAGCTTGG    junction_-chr3_127053127-chr3_12660246_NM_002880
          ------GGACGTTGGGGCGGCCTGGCTCCCTCAG|GTTTAAGAATTGTTTAAGCTGC--------
          SEQUENCER02:110:A815YFABXX:4:2108:10210:157390
          ------TGGGGCGGCCTGGCTCCCTCAG|GTTTAAGAATTGTTTAAGCTGCATCAAT-------
          SEQUENCER02:110:A815YFABXX:4:1202:13466:24305
          ------TGGGGCGGCCTGGCTCCCTCAG|GTTTAAGAATTGTTTAAGCTGCATCAAT-------
          SEQUENCER02:110:A815YFABXX:4:2201:18699:88325
          ------TGGGGCGGCCTGGCTCCCTCAG|GTTTAAGAATTGTTTAAGCTGCATCAAT-------
          SEQUENCER02:110:A815YFABXX:4:2206:15929:168642
          ------TGGGGCGGCCTGGCTCCCTCAG|GTTTAAGAATTGTTTAAGCTGCACCAAT-------
          SEQUENCER02:110:A815YFABXX:4:2204:13953:97388
          ------TGGGGCGGCCTGGCTCCCTCAG|GTTTAAGAATTGTTTAAGCTGCACCAAT-------
          SEQUENCER02:110:A815YFABXX:4:2205:7913:192360
          ------GGGGCGGCCTGGCTCCCTCAG|GTTTAAGAATTGTTTAAGCTGCATCAATG------
          SEQUENCER02:110:A815YFABXX:4:1206:15179:126394
          ------GGGGCGGCCTGGCTCCCTCAG|GTTTAAGAATTGTTTAAGCTGCATCAATG------
          SEQUENCER02:110:A815YFABXX:4:2107:20215:122947
          ------GGGGCGGCCTGGCTCCCTCAG|GTTTAAGAATTGTTTAAGCTGCATCAATG------
          SEQUENCER02:110:A815YFABXX:4:2108:5179:131134
          ------GCGGCCTGGCTCCCTCAG|GTTTAAGAATTGTTTAAGCTGCATCAATGGAG-----
          SEQUENCER02:110:A815YFABXX:4:2108:8558:12111
```

3.31 SUSD3_KIAA1429

```
110GCCAAT_6   +chr9:95821112_-chr8:95511734_SUSD3_KIAA1429_fusion_template
************************************************************************
GCCCCGGGGGGCGGGCCGGGGTCACCAGCCTGCCCCAGGGAACCGCACAG|TTCTTTAAGGAAAAACAGTAGTGCTCTGCATAGTTTAC
TGAAACGAGTGG   junction_+chr9_95821112_-chr8_95511734_NM_145006_NM_015496
************************************************************************

GCCCCAGGGAACCGCACAG|TTCTTTAAGGAAAAACAGTAGTGCTCTGCAT
              SEQUENCER02:110:A815YFABXX:6:1102:17246:133500
              ----------------------------------------------------
              GCCCCAGGGAACCGCACAG|TTCTTTAAGGAAAAACAGTAGTGCTCTGCAT
              SEQUENCER02:110:A815YFABXX:6:1103:3059:29013
              ----------------------------------------------------
              GCCCCAGGGAACCGCACAG|TTCTTTAAGGAAAAACAGTAGTGCTCTGCAT
              SEQUENCER02:110:A815YFABXX:6:1104:8694:164342
              ----------------------------------------------------
              GCCCCAGGGAACCGCACAG|TTCTTTAAGGAAAAACAGTAGTGCTCTGCAT
              SEQUENCER02:110:A815YFABXX:6:1107:12825:54873
              ----------------------------------------------------
              GCCCCAGGGAACCGCACAG|TTCTTTAAGGAAAAACAGTAGTGCTCTGCAT
              SEQUENCER02:110:A815YFABXX:6:1107:2121:165345
              ----------------------------------------------------
              GCCCCAGGGAACCGCACAG|TTCTTTAAGGAAAAACAGTAGTGCTCTGCAT
              SEQUENCER02:110:A815YFABXX:6:1203:4768:48559
              ----------------------------------------------------
              GCCCCAGGGAACCGCACAG|TTCTTTAAGGAAAAACAGTAGTGCTCTGCAT
              SEQUENCER02:110:A815YFABXX:6:1206:20633:138798
              ----------------------------------------------------
              GCCCCAGGGAACCGCACAG|TTCTTTAAGGAAAAACAGTAGTGCTCTGCAT
              SEQUENCER02:110:A815YFABXX:6:2101:12411:138330
              ----------------------------------------------------
              GCCCCAGGGAACCGCACAG|TTCTTTAAGGAAAAACAGTAGTGCTCTGCAT
              SEQUENCER02:110:A815YFABXX:6:2104:16238:79740
              ----------------------------------------------------
              GCCCCAGGGAACCGCACAG|TTCTTTAAGGAAAAACAGTAGTGCTCTGCAT
              SEQUENCER02:110:A815YFABXX:6:2106:12498:6963
              ----------------------------------------------------
              GCCCCAGGGAACCGCACAG|TTCTTTAAGGAAAAACAGTAGTGCTCTGCAT
              SEQUENCER02:110:A815YFABXX:6:2107:5244:11207
              ----------------------------------------------------
              GCCCCAGGGAACCGCACAG|TTCTTTAAGGAAAAACAGTAGTGCTCTGCAT
              SEQUENCER02:110:A815YFABXX:6:2108:8901:134467
              ----------------------------------------------------
              GCCCCAGGGAACCGCACAG|TTCTTTAAGGAAAAACAGTAGTGCTCTGCAT
              SEQUENCER02:110:A815YFABXX:6:2204:12318:65430
```

3.32 CLEC16A_BCAR4

```
110TTAGGC_1   +chr16:11154879_-chr16:11914154   CLEC16A_BCAR4_fusion_template
********************************************************************************
*************
GCTGACTCGGAGGAGGACCTGATCAAGACTGATGATGTCCTGGATCTGA|CAAAAAATCACCATGTACCAACCTATCCAAACTTATCC
ATGGATGAATCT  junction +chr16_11154879_-chr16_11914154_chr16_11914154 NM_015226_NR_024049
--------CGGGAGGAGGACCTGATCAAGACTGATGATGTCCTGGATCTGA|CAAAAAA--------------------------
          SEQUENCER02:110:A815YFABXX:1:1103:3861:153604
--------CGGGAGGAGGACCTGATCAAGACTGATGATGTCCTGGATCTGA|CAAAAAA--------------------------
          SEQUENCER02:110:A815YFABXX:1:1104:17023:99421
--------CGGGNGGAGGACCTGATCAAGACTGATGATGTCCTGGATCTGA|CAAAAAA--------------------------
          SEQUENCER02:110:A815YFABXX:1:1105:1091:199970
--------CGGGAGGAGGACCTGATCAAGACTGATGATGTCCTGGATCTGA|CAAAAAA--------------------------
          SEQUENCER02:110:A815YFABXX:1:1107:16108:140661
--------CGGGAGGAGGACCTGATCAAGACTGATGATGTCCTGGATCTGA|CAAAAAA--------------------------
          SEQUENCER02:110:A815YFABXX:1:1108:13186:169362
--------CGGGAGGAGGACCTGATCAAGACTGATGATGTCCTGGATCTGA|CAAAAAA--------------------------
          SEQUENCER02:110:A815YFABXX:1:1203:18967:146197
--------CGGGAGGAGGACCTGATCAAGACTGATGATGTCCTGGATCTGA|CAAAAAA--------------------------
          SEQUENCER02:110:A815YFABXX:1:2104:14937:169912
--------CGGGAGGAGGACCTGATCAAGACTGATGATGTCCTGGATCTGA|CAAAAAA--------------------------
          SEQUENCER02:110:A815YFABXX:1:2108:18556:189747
--------GGGGAGGAGGACCTGATCAAGACTGATGATGTCCTGGATCTGA|CAAAAAAT-------------------------
          SEQUENCER02:110:A815YFABXX:1:1202:4256:56456
--------GGGGAGGAGGACCTGATCAAGACTGATGATGTCCTGGATCTGA|CAAAAAAT-------------------------
          SEQUENCER02:110:A815YFABXX:1:1205:12943:13116
----------------------------GATGATGTCCTGGATCTGA|CAAAAAATCACCATGTACCAACCTATCCAAA------
          SEQUENCER02:110:A815YFABXX:1:1205:11530:185816
-----------------------------GATGTCCTGGATCTGA|CAAAAAATCACCATGTACCAACCTATCCAAACTT-----
          SEQUENCER02:110:A815YFABXX:1:1106:17658:3466
-----------------------------GATGTCCTGGATCTGA|CAAAAAATCACCATGTACCAACCTATCCAAACTT-----
          SEQUENCER02:110:A815YFABXX:1:2206:14354:26483
```

FIGURE 3.32A

```
###################################################################################
#################
110TTAGGC_1      +chr16:11154879_-chr16:11914154      CLEC16A_BCAR4  donor_template
*****************************************************************************
GCTGACTCGGCGGAGGAGGACCTGATCAAGACTGATGATGTCCTGGATCTGA|ATAACAGCGACTTGATTGCATGTACAGTGATCACCAAG
GATGGCGGCATG  junction +chr16_11154879_+chr16_11214472_NM_015226
-----------------GATCAAGACTGATGATGTCCTGGATCTGA|ATAACAGCGACTTGATTGCAT--------
           SEQUENCER02:110:A815YFABXX:1:2207:4962:189699
###################################################################################
#########
110TTAGGC_1      +chr16:11154879_-chr16:11914154      CLEC16A_BCAR4  acceptor_template
*****************************************************************************
TCAAGTGATTCTCCTGCTTCAGCTTCCCAAGTATCTGGGACTACAGGCAT|CAAAAAATCACCATGTACCAACCTATCCAAACTTATCC
ATGGATGAATCT  junction -chr16_11915491_-chr16_11914154_NR_024049
###################################################################################

110TTAGGC_1      +chr16:11154879_-chr16:11914154      CLEC16A_BCAR4  donor_genomic_template
*****************************************************************************
GCTGACTCGGCGGAGGAGGACCTGATCAAGACTGATGATGTCCTGGATCTGA|GTGAGTTGGCTGCTGTCTGAGTCACAGCAGGGGCTGGGG
GACACATGGGACAT  junction +chr16_11154879_NM_015226
-----------------GATCAAGATTGATGATGTCCTGGATCTGA|GTGAGTTGGCTGCTGTCTGAGTC----------
           SEQUENCER02:110:A815YFABXX:1:1205:3369:69374
-----------------GATCAAGATTGATGATGTCCTGGATCTGA|GTGAGTTGGCTGCTGTCTGAGTC----------
           SEQUENCER02:110:A815YFABXX:1:2102:9940:22308
CTGGATCTGA|GTGAGTTGGCTGCTCTGAGTCACAGCAGGGGCTGGGGA-------
    SEQUENCER02:110:A815YFABXX:1:2108:4095:191673
GGATCTGA|GTGAGTTGGCTGCTCTGAGTCACAGCAGAGGGCTGGGGACA-------
   SEQUENCER02:110:A815YFABXX:1:1626:12031
```

FIGURE 3.32B

```
##################################################################
##########
110TTAGGC_1    +chr16:11154879_-chr16:11914154    CLEC16A_BCAR4
               acceptor_genomic_template
******************************************************************
**********
CTTTTGTATTGAGCTTTCATAGACTTTTCTTCCCTTAACCACTGCAG|CAAAAAATCACCATGTACCAACCTATCCAAACTTATCC
ATGATGAATCT    junction_-chr16_11914154_NR_024049
           ---                                  ---
CCACTGCAG|CAAAAAATCACCATGTAACAACCTATCCAAACTTATCCATG-------
      SEQUENCER02:110:A815YFABXX:1:2105:12179:90914
                                                 ---
CTGCCAG|CAAAAAATCACCATGTACCAACCTATCCAAACTTATCCATGGAT-------
      SEQUENCER02:110:A815YFABXX:1:1205:20089:17672
                                                 ---
CTGCAG|CAAAAAATCACCATGTACCAACCTATCCAAACTTATCCATGGAT-------
      SEQUENCER02:110:A815YFABXX:1:2108:14124:74967
##################################################################
##########
```

FIGURE 3.32C

```
3.33 DLG5_ADK
110TTAGGC_2   -chr10:79613112_+chr10:76153899    DLG5_ADK_fusion_template
****************************************************************************
ACGAGGAGGAGACCAGAAGGAGATCGGTGACCTCCGTGACCTGCCCAGCAGCAG|TGGATGATTCAACAGCCACACAAAGCAGCAACATTTTT
TGGATGCATTGG   junction_-chr10_79613112_+chr10_76153899_NM_004747_NM_001123
            ---                                        ---
AGAAGGAGATTGGTGACCTCCGTGACCTGCCCAGCAGCAG|TGGATGATTCAA---------
        SEQUENCER02:110:A815YFABXX:2:1104:10267:130136
                                        ---
             GTGACCTCCGTGACCTGCCCAGCAGCAG|TGGATGATTCAACAGCCACACAAA---
        SEQUENCER02:110:A815YFABXX:2:2101:19362:176250
                                        ---
                  TGACCTCCGTGACCTGCCCAGCAGCAG|TGGATGATTCAACAGCCACACAAAG---
        SEQUENCER02:110:A815YFABXX:2:1106:13636:71700
```

FIGURE 3.33A

```
                    ------------TGACCTCCGTGCCCAGCAGCAG|TGGATGATTCAACAGCCACAAAAAG----------
            SEQUENCER02:110:A815YFABXX:2:2206:5416:198930
                    --------------TCCGTGCCCAGCAGAAGCAG|TGGATGATTCAACAGCCACACAAAGCAGCA--------
            SEQUENCER02:110:A815YFABXX:2:2202:1975:101249
                    ----------------CCGTGCCCAGCAGCAGCAG|TGGATGATTCAACAGCCACACAAAGCAGCAA-------
            SEQUENCER02:110:A815YFABXX:2:1108:4039:130791
                    ----------------CCGTGCCCAGCAGCAGCAG|TGGATGATTCAACAGCCACACAAAGCAGCAA-------
            SEQUENCER02:110:A815YFABXX:2:1203:5845:155055
                    ----------------CCGTGCCCAGCAGCAGCAG|TGGATGATTCAACAGCCACACAAAGCAGCAA-------
            SEQUENCER02:110:A815YFABXX:2:1208:9161:52606
                    ----------------CCGTGCCCAGCAGCAGCAG|TGGATGATTCAACAGCCACACAAAGCAGCAA-------
            SEQUENCER02:110:A815YFABXX:2:2101:14537:187703
                    ------------------CGTGCCCAGCAGCAGCAG|TGGATGATTCAACAGCCACACAAAGCAGCAA-------
            SEQUENCER02:110:A815YFABXX:2:2101:3407:110160
                    ------------------CGTGCCCAGCAGCAGCAG|TGGATGATTCAACAGCCACACAAAGCAGCAA-------
            SEQUENCER02:110:A815YFABXX:2:2102:16661:89286
                    --------------------GTGCCCAGCAGCAGCAG|TGGATGATTCAACAGCCACACAAAGCAGCAACA-----
            SEQUENCER02:110:A815YFABXX:2:1103:10615:15715
                    --------------------GTGCCCAGCAGCAGCAG|TGGATGATTCAACAGCCCCACAAAGCAGCAACA-----
            SEQUENCER02:110:A815YFABXX:2:1206:2965:62651
                    --------------------GTGCCCAGCAGCAGCAG|TGGATGATTCAACAGCCACACAAAGCAGCAACA-----
            SEQUENCER02:110:A815YFABXX:2:2205:21249:72510
                    ----------------------CCAGCAGCAGCAG|TGGATGATTCAACAGCCACACAAAGCAGCAACATTTT-
            SEQUENCER02:110:A815YFABXX:2:2107:4822:109287

AGCAG|TGGATGATTCAACAGCCACAAAGCAGCAACATTTTTGGATG-----
        SEQUENCER02:110:A815YFABXX:2:1105:14179:190542
AGCAG|TGGATGATTCAACAGCCACACAAAGCAGCAACATTTTTGGATG-----
        SEQUENCER02:110:A815YFABXX:2:2108:5543:61830
###################################################################
110TTAGGC_2  -chr10:79613112_+chr10:76153899    DLG5_ADK_donor_template
###################################################################
```

FIGURE 3.33B

```
************************************************************************
***************
ACGAGGAGGACCAGAAGGAGATCGGTGACCTCCGTGCCCAGCAGCAG|GTGTTGAAGCACAACGGGTCATCCGAGATTCTCAACAA
ACTGTATGACAC    junction_-chr10_79613112_-chr10_79603464_NM_004747
--------                GTGCCCAGCAGCAG|GTGTTGAAGCACAACGGGTCATCCGAGATTCTC------
             SEQUENCER02:110:A815YFABXX:2:2101:7185:17697
CAGCAGCAG|GTGTTGAAGCACAACGGGTCATCCGAGATTCTCAACAA------------------------
             SEQUENCER02:110:A815YFABXX:2:2104:18609:30888
GCAGCAGCAG|GTGTTGAAGCACAACGGGTCATCCGAGATTCTTAACAAAC---------------------
             SEQUENCER02:110:A815YFABXX:2:1204:11520:170085
GCAGCAGCAG|GTGTTGAAGCACAACGGGTCATCCGAGATTCTTAACAAAC---------------------
             SEQUENCER02:110:A815YFABXX:2:2105:2144:183871
GCAGCAGCAG|GTGTTGAAGCACAACGGGTCATCCGAGATTCTTAACAAAC---------------------
             SEQUENCER02:110:A815YFABXX:2:2107:7012:8867
CAGCAGCCAG|GTGTTGAAGCACAACGGGTCATCCGAGATTCTCAACAAACT--------------------
             SEQUENCER02:110:A815YFABXX:2:2102:19704:111032
CAGCAGCCAG|GTGTTGAAGCACAACGGGTCATCCGAGATTCTCAACAAACT--------------------
             SEQUENCER02:110:A815YFABXX:2:2205:19469:76109
CAGCAGCCAG|GTGTTGAAGCACAACGGGTCATCCGAGATTCTCAACAAACT--------------------
             SEQUENCER02:110:A815YFABXX:2:2205:4757:71058
########################################################################
##########
110TTAGGC_2  -chr10:79613112_+chr10:76153899   DLG5_ADK_acceptor_template
*****************                ****************************************
*************
```

FIGURE 3.33C

```
TCGAATATCATGCTGGTGGCTCTACCAGAATTCAATTAAAGTGGCTCAG|TGGATGATTCAACAGCCACACAAAGCAGCAACATTTTT
TGGATGCATTGG    junction_+chr10_76074503_+chr10_76153899_NM_001123
##############################################################################
110TTAGGC_2     -chr10:79613112_+chr10:76153899       DLG5_ADK  donor_genomic_template
**************************************************************************************

ACGAGGAGGACCAGAAGGAGATCGGTGACCTCCGTGCCCAGCAGCAGCAG|GTAGGCCCAGCCCCTGGAGACTGGCCATTTCTCCCAAG
TAGTCCTCATTC    junction_-chr10_79613112_NM_004747
##############################################################################
110TTAGGC_2     -chr10:79613112_+chr10:76153899       DLG5_ADK  acceptor_genomic_template
**************************************************************************************

TGTGTACCATTTTTTTGCCCCATTAAATTATTTATGTTCCTGTTTTACAG|TGGATGATTCAACAGCCACACAAAGCAGCAACATTTTT
TGGATGCATTGG    junction_+chr10_76153899_NM_001123
##############################################################################
```

FIGURE 3.33D

3.34 PPP2R1A_NLRP8

```
110TTAGGC_2     +chr19:52709316_+chr19:56473433       PPP2R1A_NLRP8  fusion_template
**************************************************************************************
GAACCTTCACTACCCTGGTGGGAGGCCCAGAGTACGTGCACTGCCTGCTG|AGCGCCAGAGAGCAATGGGCTGCATCGTTGGTGGCAAG
ACTTATGCTCTG    junction_+chr19_52709316_+chr19_56473433_NM_014225_NM_176811
                ------GGTGGGAGGCCCAGAGTACGTGCACTGCCTGCTG|AGCGCCAGAGAGCAAT------------------
                SEQUENCER02:110:A815YFABXX:2:1102:2465:145176
                ------GGTGGGAGGCCCAGAGTACGTGCACTGCCTGCTG|AGCGCCAGAGAGCAAT------------------
                SEQUENCER02:110:A815YFABXX:2:2101:1628:36592
                ------GTGGGAGGCCCAGAGTACGTGCACTGCCTGCTG|AGCGCCAGAGAGCAATG-----------------
                SEQUENCER02:110:A815YFABXX:2:1105:4274:198772
                ------GTGGGAGGCCCAGAGTACGTGCACTGCCTGCTG|AGCGCCAGAGAGCAATG-----------------
                SEQUENCER02:110:A815YFABXX:2:1207:15554:83830
```

FIGURE 3.34A

```
################################################################################
################
110TTAGGC_2      +chr19:52709316_+chr19:56473433       PPP2R1A_NLRP8   donor_template
*********************************************************************************
************
GAACCTTCACTACCCTGGTGGAGGCCCAGAGTACGTGCACTGCCTGCTG|CCACCGCTGGAGTCGCTGGCCACAGTGGAGGAGACAGT
GGTGCGGGACAA     junction_+chr19_52709316_+chr19_52714513_NM_014225
----------------GGGAGGCCCAGAGTACGTGCATGCCTGCTG|CCACCGCTGGAGTCGCTGG-----------------
#################################################################################
            SEQUENCER02:110:A815YFABXX:2:1106:16145:178613
#################################################################################
110TTAGGC_2      +chr19:52709316_+chr19:56473433       PPP2R1A_NLRP8   acceptor_template
*********************************************************************************
************
AACTTCATGAACGTGTGGAAGCTCAGTCCAGCTCCCAGCTCCCATCCTGGCTCTGA|AGCGCCAGAGAGCAATGGGCTGCATCGTTGGTGGCAAG
ACTTATGCTCTG     junction_+chr19_56467466_+chr19_56473433_NM_176811
#################################################################################
            ##############
110TTAGGC_2      +chr19:52709316_+chr19:56473433       PPP2R1A_NLRP8   donor_genomic_template
*********************************************************************************
************
GAACCTTCACTACCCTGGTGGAGGCCCAGAGTACGTGCACTGCCTGCTG|GTGAGTGGAAGGCAGGAAGTCCTCTTGCCACCCCTTA
GGGTCGGCCCAT     junction_+chr19_52709316_NM_014225
#################################################################################
            ##############
110TTAGGC_2      +chr19:52709316_+chr19:56473433       PPP2R1A_NLRP8
            acceptor_genomic_template
*********************************************************************************
************
TTTCTCCAGTTTAACGAAGAGGTGTTTCTCTTCTCCCTTCCATGTAG|AGCGCCAGAGAGCAATGGCTGCATCGTTGGTGGCAAG
ACTTATGCTCTG     junction_+chr19_56473433_NM_176811
#################################################################################
##############
```

FIGURE 3.34B

```
3.35 FBXW7_MLL3

110TTAGGC_3        -chr4:153332455 -chr7:152055760       FBXW7_MLL3      fusion_template
*****************************************************************************************
ACCTGCCCGTTCACCAACTCTCCTCCCCATTCTATACAAAACAACAAAA|ACCTCGAAGTAGGGGAAAACTGCAGTGGAAGATGAGG
ACAGCATGGATG    junction_-chr4_153332455_-chr7_152055760_NM_033632_NM_170606
       SEQUENCER02:110:A815YFABXX:3:2108:10244:67326
  ----CCTCCCCATTCTATACAAAACAACAAAA|ACCTCGAAGTAGGGGAAAAC---------
       SEQUENCER02:110:A815YFABXX:3:2203:6477:138856
  ----CCTCCCCATTCTATACAAAACAACAAAA|ACCTCGAAGTAGGGGAAAAC---------
       SEQUENCER02:110:A815YFABXX:3:1205:5062:79567
  ----TCTATACAAAACAACAAAA|ACCTCGAAGTAGGGGAAAACTGCAGTGGA----------
###########################################################################################

110TTAGGC_3        -chr4:153332455 -chr7:152055760       FBXW7_MLL3      donor_template
*****************************************************************************************
ACCTGCCCGTTCACCAACTCTCCTCCCCATTCTATACAAAACAACAAAA|ATGAAAGAAAAGTTGGACCATGGTTCTGAGGTCCGCTC
TTTTTCTTTGGG    junction_-chr4_153332455_-chr7_153271276_NM_033632
###########################################################################################

110TTAGGC_3        -chr4:153332455 -chr7:152055760       FBXW7_MLL3      acceptor_template
*****************************************************************************************
GGCCGGCCTCGCAAAGATGGCGCTTCCCTTTCCAGAGAGCCAGAAGAA|ACCTCGAAGTAGGGGAAAACTGCAGTGGAAGATGAGG
ACAGCATGGATG    junction_-chr7_152132711_-chr7_152055760_NM_170606
  ---CAGAGAGCCAGAAGAA|ACCTCGAAGTAGGGGAAAACTGCAGTGGAAGA----
       SEQUENCER02:110:A815YFABXX:3:1207:11276:197772
```

FIGURE 3.35A

```
----------------------------------------------------------------------
CCAGAAAGAA|ACCTCGAAGTAGGGGAAAAACTGCAGTGGAAGATGAGGA-------------------
           SEQUENCER02:110:A815YFABXX:3:2108:12814:164578
####################################################################
110TTAGGC_3    -chr4:153332455_-chr7:152055760    FBXW7_MLL3    donor_genomic_template
********************************************************************
ACCTGCCCGTTCACCAACTCTCCTCCCCATTCTATACAAAAACAACAAAA|GTGAGTATATTCAATATATTGTTAACCTGAGAAACTTT
ACATATCTATTT    junction_-chr4_153332455_NM_033632
####################################################################
110TTAGGC_3    -chr4:153332455_-chr7:152055760    FBXW7_MLL3
           acceptor_genomic_template
********************************************************************
AAATTAACATTTAACTCTATGTACTTATTATTTTTTTTTTTTTTTCTGTAG|ACCTCGAAGTAGGGGAAAAACTGCAGTGGAAGATGAGG
ACAGCATGGATG    junction_-chr7_152055760_NM_170606
####################################################################
```

FIGURE 3.35B

3.36 PIK3C3_RPRD1A
```
110TTAGGC_4    +chr18:39629569_-chr18:33613800    PIK3C3_RPRD1A    fusion_template
********************************************************************
ACTTGGAGTTGGAGACAGGCACCTGGATAACCTTTTGCTAACAAAAACAG|CCAAACCAAACAGGAAGCTTACTTTTTCTCTACCTAGCC
AATGATGTCATA    junction_+chr18_39629569_-chr18_33613800_NM_002647_NM_018170
---------------GGCACCTGGATAACCTTTTGCTAACAAAAACAG|CCAAACCAAACAGGAAG--------------------
           SEQUENCER02:110:A815YFABXX:4:1207:20007:171725
------------------GGATAACCTTTTGCTAACAAAAACAG|CCAAACCAAACAGGAAGCTTACTT--------------
           SEQUENCER02:110:A815YFABXX:4:1207:14948:128853
```

FIGURE 3.36A

```
################################################################################
##############
110TTAGGC_4     +chr18:39629569_-chr18:33613800    PIK3C3_RPRD1A donor_template
********************************************************************************
**************
ACTTGGAGTTGGAGACAGGCACCTGGATAACCTTTGCTAACAAAAACAG|GCAAACTCTTCCACATAGACTTTGGATATATTTGGGT
CGGGATCCAAAG    junction_+chr18_39629569_+chr18_39637847_NM_002647
------AGGCACCTGGATAACCTTTGCTAACAAAAACAG|GCAAACTCTCTTCCACAT------------------------
            SEQUENCER02:110:A815YFABXX:4:1106:9138:135528
------------GGATAACCTTTGCTAACAAAAACAG|GCAAACTCTTCCACATAGACTTTG-----------------
            SEQUENCER02:110:A815YFABXX:4:1204:3208:23279
################################################################################
##############
110TTAGGC_4     +chr18:39629569_-chr18:33613800    PIK3C3_RPRD1A acceptor_template
********************************************************************************
*************
TAAACACTCGCGTCCCATCGTCACCGTGTGGGAGCGGGAGCTGCGGAAAG|CCAAACCAAACAGGAAGCTTACTTTTCTCTACCTAGCC
AATGATGTCATA    junction_-chr18_33647217_-chr18_33613800_NM_018170
----CCGTGTGGGAGCGGGAGCTGCGGAAAG|CCAAACCAAACAGGAAGCTTACT---------------------
            SEQUENCER02:110:A815YFABXX:4:1105:5553:47976
------GTGTGGGAGCGGGAGCTGCGGAAAG|CCAAACCAAACAGGAAGCTTACTTT-----------------
            SEQUENCER02:110:A815YFABXX:4:1104:13788:199630
------GTGTGGGAGCGGGAGCTGCGGAAAG|CCAAACCAAACAGGAAGCTTACTTT-----------------
            SEQUENCER02:110:A815YFABXX:4:1108:15623:116925
------GTGTGGGAGCGGGAGCTGCGGAAAG|CCAAACCAAACAGGAAGCTTATTT-------------------
            SEQUENCER02:110:A815YFABXX:4:1206:11929:118482
------GTGTGGGAGCGGGAGCTGCGGAAAG|CCAAACCAAACAGGAAGCTTACTTT-----------------
            SEQUENCER02:110:A815YFABXX:4:2105:6871:193587
------GTGTGGGAGCGGGAGCTGTGGAAAG|CCAAACCAAACAGGAAGCTTACTTT-----------------
            SEQUENCER02:110:A815YFABXX:4:2106:21202:121785
------TGTGGGAGCGGGAGCTGCGGAAAG|CCAAACCAAACAGGAAGCTTACTTT------------------
            SEQUENCER02:110:A815YFABXX:4:2104:16924:146377
```

FIGURE 3.36B

```
----------------------------GTGGGAGCGGGAGCTGCGGAAAG|CCAAACCAAACAGGAAGCTTACTTTTC----------
------------SEQUENCER02:110:A815YFABXX:4:1105:19899:157289
----------------------------GTGGGAGCGGGAGCTGCGGAAAG|CCAAACCAAACAGGAAGCTTACTTTT-----------
------------SEQUENCER02:110:A815YFABXX:4:1107:15689:14119
----------------------------GTGGGAGCGGGAGCTGCGGAAAG|CCAAACCAAACAGGAAGCTTACTTTC-----------
------------SEQUENCER02:110:A815YFABXX:4:1202:14728:135265
----------------------------GTGGGAGCGGGAGCTGCGGAAAG|CCAAACCAAACAGGAAGCTTACTTTT-----------
------------SEQUENCER02:110:A815YFABXX:4:1206:11538:139878
----------------------------GTGGGAGCGGGAGCTGCGGAAAG|CCAAACCAAACAGGAAGCTTACTTTTC----------
------------SEQUENCER02:110:A815YFABXX:4:1208:7217:152126
----------------------------GTGGGAGCGGGAGCTGCGGAAAG|CCAAACCAAATAGGAAGCTTACTTTTC----------
------------SEQUENCER02:110:A815YFABXX:4:2104:11279:133558
----------------------------GTGGGAGCGGGAGCTGCGGAAAG|CCAAACCAAACAGGAAGCTTACTTTT-----------
------------SEQUENCER02:110:A815YFABXX:4:2108:13481:48894
----------------------------GTGGGAGCGGGAGCTGCGGAAAG|CCAAACCAAACAGGAAGCTTACTTTT-----------
------------SEQUENCER02:110:A815YFABXX:4:2108:14601:111572
----------------------------GTGGGAGCGGGAGCTGCGGAAAG|CCAAACCAAACAGGAAGCTTACTTTTC----------
------------SEQUENCER02:110:A815YFABXX:4:2201:5967:82592
----------------------------GTGGGAGCGGGAGCTGCGGAAAG|CCAAACCAAACAGGAAGCTTACTTTTC----------
------------SEQUENCER02:110:A815YFABXX:4:2202:15725:171446
----------------------------GTGGGAGCGGGAGCTGCGGAAAG|CCAAACCAAACAGGAAGCTTACTTTT-----------
------------SEQUENCER02:110:A815YFABXX:4:2202:16008:199348
-------------------------TGGGAGCGGGAGCTGCGGAAAG|CCAAACCAAACAGGAAGCTTACTTTTCT---------
------------SEQUENCER02:110:A815YFABXX:4:2205:12707:177404
----------------------------GGGAGCGGGAGCTGCGGAAAG|CCAAACCAAACAGGAAGCTTACTTTTCTC--------
------------SEQUENCER02:110:A815YFABXX:4:1106:11300:133927
----------------------------GGGAGCGGGAGCTGCGGAAAG|CCAAACCAAACAGGAAGCTTACTTTTCTC--------
------------SEQUENCER02:110:A815YFABXX:4:1106:18332:13316
----------------------------GGGAGCGGGAGCTGCGGAAAG|CCAAACCAAACAGGAAGCTTACTTTTCTC--------
------------SEQUENCER02:110:A815YFABXX:4:2206:1594:149304
-------------------------GCGGGAGCGGGAGCTGCGGAAAG|CCAAACCAAACAGGAAGCTTACTTTTTCTACC------
------------SEQUENCER02:110:A815YFABXX:4:1106:19335:197152
```

FIGURE 3.36C

```
----------------------------------------------------------------------CGGGAGCTGCGGAAAG|CCAAACCAAACAGGAAGCTTACTTTTCTCTACCT----  SEQUENCER02:110:A815YFABXX:4:1208:9668:80128
----------------------------------------------------------------------CGGGAGCTGCGGAAAG|CCAAACCAAACAGGAAGCTTACTTTTCTCTACCT----  SEQUENCER02:110:A815YFABXX:4:2105:12174:47728
###############################################################################################################################
110TTAGGC_4    +chr18:39629569_-chr18:33613800    PIK3C3_RPRD1A  donor_genomic_template
*******************************************************************************************************
ACTTGCACTTGGAGACAGGCACCTGGATAACCTTTGCTAACAAAAACAG|GTAACAATTAATGACTACCAGTAGACATACATTGTATA
TGCCCATGGTTT  junction_+chr18_39629569_NM_002647
----AGGCACCTGGATAACCTTTGCTAACAAAAACAG|GTAACAATTAATGACT----  SEQUENCER02:110:A815YFABXX:4:1104:11430:183441
----AGGCACCTGGATAACCTTTGCTAACAAAAACAG|GTAACAATTAATGACT----  SEQUENCER02:110:A815YFABXX:4:1108:7314:82709
----AGGCACCTGGATAACCTTTGCTAACAAAAACAG|GTAACAATTAATGACT----  SEQUENCER02:110:A815YFABXX:4:2102:9875:125492
----AGGCACCTGGATAACCTTTGCTAACAAAAACAG|GTAACAATTAATGACT----  SEQUENCER02:110:A815YFABXX:4:2105:13979:15421
----AGGCACCTGGATAACCTTTGCTAACAAAAACAG|GTAACAATTAATGACT----  SEQUENCER02:110:A815YFABXX:4:2106:14262:162196
----AGGCACCTGGATAACCTTTGCTAACAAAAACAG|GTAACAATTAATGACT----  SEQUENCER02:110:A815YFABXX:4:2205:14459:160507
###############################################################################################################################
110TTAGGC_4    +chr18:39629569_-chr18:33613800    PIK3C3_RPRD1A
                acceptor_genomic_template
*******************************************************************************************************
TCCAAGTAAAGATGTTTAAGTAGATTTTTAACTTTTTCTTATTTTTCAG|CCAAACCAAACAGGAAGCTTACTTTTCTCTACCTAGCC
AATGATGTCATA   junction_-chr18_33613800_NM_018170
###############################################################################################################################
```

FIGURE 3.36D

3.37 CHIA_ZNF138

```
110TTAGGC_5       +chr1:111833572_+chr7:64291829       CHIA_ZNF138    fusion_template
******************************************************************************************
GGAGCCCAGGCTGTGCTTTCCAGTCTGGTGGTGAATCCTCCATAGTCTG|CTCTGTGTTCTCGTTTGCCAAGACCTTTGGCTAGAG
CAGAACATAAAA      junction_+chr1_1118335720_+chr7_64291829_NM_021797_NM_006524
------------GGTGGTGAATCCTCCATAGTCTG|CTCTGTGTTCTCGTTTGCCCAAGACC---------------------------
       SEQUENCER02:110:A815YFABXX:5:1108:4481:116790
------------GGTGGTGAATCCTCCATAGTCTG|CTCTGTGTTCTCGTTTGCCCAAGACC---------------------------
       SEQUENCER02:110:A815YFABXX:5:1204:8981:191185
------------GGTGGTGAATCCTCCATAGTCTG|CTCTGTGTTCTCGTTTGCCCAAGACC---------------------------
       SEQUENCER02:110:A815YFABXX:5:1208:12357:43602
------------GGTGGTGAATCCTCCATAGTCTG|CTCTGTGTTCTCGTTTGCCCAAGACC---------------------------
       SEQUENCER02:110:A815YFABXX:5:2107:20878:102197
------------GGTGGTGAATCCTCCATAGTCTG|CTCTGTGTTCTCGTTTGCCCAAGACC---------------------------
       SEQUENCER02:110:A815YFABXX:5:2201:8013:25575
------------GGTGGTGAATCCTCCATAGTCTG|CTCTGTGTTCTCGTTTGCCCAAGACC---------------------------
       SEQUENCER02:110:A815YFABXX:5:2203:12777:78505
------------GGTGGTGAATCCTCCATAGTCTG|CTCTGTGTTCTCGTTTGCCCAAGACC---------------------------
       SEQUENCER02:110:A815YFABXX:5:2206:12472:113773
------------GGTGGTGAATCCTCCATAGTCTG|CTCTGTGTTCTCGTTTGCCCAAGACC---------------------------
       SEQUENCER02:110:A815YFABXX:5:2207:6628:59908
##############################################################################################
110TTAGGC_5       +chr1:111833572_+chr7:64291829       CHIA_ZNF138    donor_template
**********************************************************************************************
GGAGCCCAGGCTGTGCTTTCCAGTCTGCTGGTGAATCCTCCATAGTCTG|GAACAGCCAGCTGAAAACTCTCCTGGCCATTGGGAGGCT
GGAACTTCGGGA      junction_+chr1_1118335720_+chr1_111857162_NM_021797
##############################################################################################
```

FIGURE 3.37A

```
110TTAGGC_5     +chr1:111833572_+chr7:64291829     CHIA_ZNF138     acceptor_template
***************************************************************************************
***********

TGTATATAGGCATGTGATGTTAGAGAACTACAGAAACCTGGTTTCTTGG|CTCTGTGTTCTCGTTTGCCCAAGACCTTTGGCTAGAG
CAGAACATAAAA    junction_+chr7_64275422_+chr7_64291829_NM_006524
#######################################################################################
#############

110TTAGGC_5     +chr1:111833572_+chr7:64291829     CHIA_ZNF138     donor_genomic_template
***************************************************************************************
***********

GGAGCCCAGGCTGTTGCTTTCCAGTCTGGTGGTAGAATCCTCCATAGTCTG|GTGAGTGTAAATATATATATATCTTTTCCCTTCTCCCT
TTCCCATTGCAA    junction_+chr1_111833572_NM_021797
#######################################################################################
############

110TTAGGC_5     +chr1:111833572_+chr7:64291829     CHIA_ZNF138
acceptor_genomic_template
***************************************************************************************
***********

TCATCTGAGTCTAGCAGGTGGAGTAATTGTTATTTTTGTTCTTTCAG|CTCTGTGTTCTCGTTTGCCCAAGACCTTTGGCTAGAG
CAGAACATAAAA    junction_+chr7_64291829_NM_006524
----------GGTGGAGTAATTTGTTATTTTTGTTCTTTCAG|CTCTGTGTTCTCG---------------
                SEQUENCER02:110:A815YFABXX:5:1204:10735:100242
#######################################################################################
############
```

FIGURE 3.37B

3.38 RTN3_ANK1

```
110TTAGGC_6     +chr11:63449250_-chr8:41591587     RTN3_ANK1 fusion_template
***************************************************************************************
*************

AGGAGCCTGCCCGCCCTGGGACGAAGAGCTGCAGCTCCTCCTGTGCGG|AATGGGTTGAATGGCTTGCATCTGGCTTCTAAGGAAGG
CCATGTGAAAAT    junction_+chr11_63449250_-chr8_41591587_NM_006054_NM_000037
```

FIGURE 3.38A

```
                                              -------GGGGACGAAGAGCTCCAGCTCCTCCTGTGCGG|AATGGGTTGAATGGCTTG-------
                                              SEQUENCER02:110:A815YFABXX:6:1207:6720:94797
                                                   -----CTGCAGCTCCTCCTGTGCGG|AATGGGTTGAATGGCTTGCATCTGGCTTCT----
                                                   SEQUENCER02:110:A815YFABXX:6:1205:13845:162123
CCTGTGCGG|AATGGGTTGAATGGCTTGCATCTGGCTTCTAAGGAAGGCCA------
SEQUENCER02:110:A815YFABXX:6:1205:3874:66777
CCTGTGCGG|AATGGGTTGAATGGCTTGCATCTGGCTTCTAAGGAAGCC--------
SEQUENCER02:110:A815YFABXX:6:1207:15746:149526
CCTGTGCGG|AATGGGTTGAATGGCTTGCATCTGGCTTCTAAGGAAGCCA-------
SEQUENCER02:110:A815YFABXX:6:2106:11411:31743
CCTGTGCGG|AATGGGTTGAATGGCTTGCATCTGGCTTCTAAGGAAGCCA-------
SEQUENCER02:110:A815YFABXX:6:2206:14686:87433
GTGCGG|AATGGGTTGAATGGCTTGCATCTGGCTTCTAAGGAAGTCATGT-------
SEQUENCER02:110:A815YFABXX:6:1208:17068:65740
###################################################################################################
110TTAGGC_6    +chr11:63449250  -chr8:41591587    RTN3_ANK1 donor_template
**************************************************************************************************
AGGAGCCTGCCCGCCCTGGGGACGAAGAGCTGCAGCTCCTCCTGTGCGG|TGCACGATCTGATTTTCTGGAGAGATGTGAAGAAGACT
GGGTTTGTCTTT  junction +chr11_63449250_+chr11_63517463_NM_006054
           ----CTGGGGACGAAGAGCTGCAGCTCCTCCTGTGCGG|TGCACGATCTGATTTT------
           SEQUENCER02:110:A815YFABXX:6:2108:3794:58719
             --TGGGGACGAAGAGCTGCAGCTCCTCCTGTGCGG|TGCACGATCTGATTTTC-----
             SEQUENCER02:110:A815YFABXX:6:2103:18592:169848
               ---GGGACGAAGAGCTGCAGCTCCTCCTGTGCGG|TGCACGATCTGATTTTC----
               SEQUENCER02:110:A815YFABXX:6:1105:16661:127777
```

FIGURE 3.38B

FIGURE 3.38C 3.39 CEP152_IQGAP1

```
110TTAGGC_6    -chr15:49059257_+chr15:90976951    CEP152_IQGAP1_fusion_template
***************************************************************************************
AATTGACTCTCAGGAAGACCACTGAAAAGGAGCAACAGACTCAGGAGAAG|ATTTTTTACCCAGAAACTACAGATATCTATGATCGAAA
GAACATGCCAAG  junction_-chr15_49059257_+chr15_90976951_NM_014985_NM_003870
  ------------AAGGAGCAACAGACTCAGGAGAAG|ATTTTTTACCCAGAAACTACAGATAT------ SEQUENCER02:110:A815YFABXX:6:1102:10221:79017
  ------------AAGGAGCAACAGACTCAGGAGAAG|ATTTTTTACCCAGAAACTACAGATAT------ SEQUENCER02:110:A815YFABXX:6:1102:18588:110418
  ------------AAGGAGCAACAGACTCAGGAGAAG|ATTTTTTACCCAGAAACTACAGATAT------ SEQUENCER02:110:A815YFABXX:6:1102:2030:19473
  ------------AAGGAGCAACAGACTCAGGAGAAG|ATTTTTTACCCAGAAACTACAGATAT------ SEQUENCER02:110:A815YFABXX:6:1107:7467:171895
  ------------AAGGAGCAACAGACTCAGGAGAAG|ATTTTTTACCCAGAAACTACAGATAT------ SEQUENCER02:110:A815YFABXX:6:1207:4562:76051
  ------------AAGGAGCAACAGACTCAGGAGAAG|ATTTTTTACCCAGAAACTACAGATAT------ SEQUENCER02:110:A815YFABXX:6:2101:12788:80669
####################################################################################
110TTAGGC_6    -chr15:49059257_+chr15:90976951    CEP152_IQGAP1_donor_template
***************************************************************************************
AATGACTCTCAGGAAGACCACTGAAAAGGAGCAACAGACTCAGGAGAAG|ATCAAAGAAAAACTCATTCAACAGCTTGAAAAGGAGTG
GCAGTCTAAGCT  junction_-chr15_49059257_-chr15_49054869_NM_014985
#########################################################################################
110TTAGGC_6    -chr15:49059257_+chr15:90976951    CEP152_IQGAP1_acceptor_template
***************************************************************************************
```

FIGURE 3.39A

```
ATAATGTGATTCAGTGGTTGAATGCCATGGATGAGATTGGATTGCCTAAG|ATTTTTTACCCAGAAACTACAGATATCTATGATCGAAA
GAACATGCCAAG  junction +chr15_90972898_+chr15_90976951_NM_003870
############***************************************|***************************************
110TTAGGC_6   -chr15:49059257 +chr15:90976951    CEP152_IQGAP1 donor_genomic_template
***********************************************************************************************

AATTGACTCTCAGGAAGACCACTGAAAAGGAGCAACAGACTCAGGAGAAG|GTACAGTACAAGTTTATGTTGTATCGACATCCTTTCAC
TCTTCAAGCCTC  junction -chr15_49059257_NM_014985
############***************************************|***************************************
110TTAGGC_6   -chr15:49059257 +chr15:90976951    CEP152_IQGAP1
             acceptor_genomic_template
***********************************************************************************************

ATGAACACAGTGAATGGATATCTTACTCTGTTTCTTTTATTCTCCCTAG|ATTTTTTACCCAGAAACTACAGATATCTATGATCGAAA
GAACATGCCAAG  junction +chr15_90976951_NM_003870
############***************************************|***************************************
```

FIGURE 3.39B

3.40 IGF1R_DCC

```
110TTAGGC_6   +chr15:99442850 +chr18:50278424    IGF1R_DCC fusion_template
***********************************************************************************************
TCCTTCCTAAAAAACCTTCGCCTCATCCTAGGAGAGAGCAGCTAGAAGG|GTTTTCAAATTAAAGCTTTCACAGCACTGCGCTTCCTC
TCAGAACCTTCT  junction +chr15_99442850_+chr18_50278424_NM_000875_NM_005215
***********************************************|***************************************
           ---------------------AGGAGAGGAGCAGCTAGAAGG|GTTTTCAAATTAAAGCTTTCACAGCACTG--------
           SEQUENCER02:110:A815YFABXX:6:1205:4216:184049
-----------------------------AGGAGAGGAGCAGCTAGAAGG|GTTTTCAAATTAAAGCTTTCACAGCACTG--------
           SEQUENCER02:110:A815YFABXX:6:2201:13394:152164
############***************************************|***************************************
```

FIGURE 3.40A

```
110TTAGGC_6   +chr15:99442850_+chr18:50278424    IGF1R_DCC_donor_template
**************************************************************************************************
TCCTTCCTAAAAAACCTTGCCCTCATCCTAGGAGAGGAGCAGCTAGAAGG|GAATTACTCCTTCTACGTCCTCGACAACCAGAACTTGC
AGCAACTGTGGG  junction +chr15_99442850_+chr15_99451914_NM_000875
------------  --TCGCTTCATCCTAGGAGAGGAGCAGCTAGAAGG|GAATTACTCCTTCTACG----------------------
------------  --TCGCCTCATCCTAGGAGAGGAGCAGCTAGAAGG|GAATTACTCCTTCTACG----------------------  SEQUENCER02:110:A815YFABXX:6:2204:10414:187224
------------  ----CGCCTCATCCTAGGAGAGGAGCAGCTAGAAGG|GAATTACTCCTTCTACGT--------------------  SEQUENCER02:110:A815YFABXX:6:2206:20891:65099
------------  ----CGCCTCATCCTAGGAGAGGAGCAGCTAGAAGG|GAATTACTCCTTCTACGT--------------------  SEQUENCER02:110:A815YFABXX:6:1102:20818:32254
------------  ----CGCCTCATCCTAGGAGAGGAGCAGCTAGAAGG|GAATTACTCCTTCTACGT--------------------  SEQUENCER02:110:A815YFABXX:6:1106:8533:115756
------------  ------GCCTCATCCTAGGAGAGGAGCAGCTAGAAGG|GAATTACTCCTTCTACGTC-------------------  SEQUENCER02:110:A815YFABXX:6:2204:4547:29770
------------  ------GCCTCATCCTAGGAGAGGAGCAGCTAGAAGG|GAATTACTCCTTCTACGTC-------------------  SEQUENCER02:110:A815YFABXX:6:2205:1533:146807
------------  --------CATCCTAGGAGAGGAGCAGTTAGAAGG|GAATTACTCCTTCTACGTCCTCG----------------  SEQUENCER02:110:A815YFABXX:6:1107:14492:50260
------------  --------CATCCTAGGAGAGGAGCAGTTAGAAGG|GAATTACTCCTTCTACGTCCTCG----------------  SEQUENCER02:110:A815YFABXX:6:1107:7607:9686
------------  --------CATCCTAGGAGAGGAGCAGTTAGAAGG|GAATTACTCCTTCTACGTCCTCG----------------  SEQUENCER02:110:A815YFABXX:6:1207:6598:85261
------------  --------CATCCTAGGAGAGGAGCAGTTAGAAGG|GAATTACTCCTTCTACGTCCTCG----------------  SEQUENCER02:110:A815YFABXX:6:2205:3925:199452
------------  --------CATCCTAGGAGAGGAGCAGTTAGAAGG|GAATTACTCCTTCTACGTCCTCG----------------  SEQUENCER02:110:A815YFABXX:6:2207:1684:127377
------------  ----------AGGAGAGGAGCAGCTAGAAGG|GAATTACTCCTTCTACGTCCTCGACAACC--------------  SEQUENCER02:110:A815YFABXX:6:1102:9148:86678
------------  ----------AGGAGAGGAGCAGCTAGAAGG|GAATTACTCCTTCTACGTCTTCGACAACC--------------  SEQUENCER02:110:A815YFABXX:6:1103:13062:87115
------------  ----------AGGAGAGGAGCAGCTAGAAGG|GAATTACTCCTTCTACGTCCTCGACAACC--------------  SEQUENCER02:110:A815YFABXX:6:1103:5741:34371
```

FIGURE 3.40B

```
-------------------------AGGAGAGGAGCAGCTAGAAGG|GAATTACTCCTTCTACGTCTTCGACAACC-----------
------SEQUENCER02:110:A815YFABXX:6:1104:11630:193816
-------------------------AGGAGAGGAGCAGCTAGAAGG|GAATTACTCCTTCTACGTCTTCGACAACC-----------
------SEQUENCER02:110:A815YFABXX:6:1104:16891:80296
-------------------------AGGAGAGGAGCAGCTAGAAGG|GAATTACTCCTTCTACGTCTTCGACAACC-----------
------SEQUENCER02:110:A815YFABXX:6:1104:19882:90926
-------------------------AGGAGAGGAGCAGCTAGAAGG|GAATTACTCCTTCTACGTCCTCGACAACC-----------
------SEQUENCER02:110:A815YFABXX:6:1108:21340:82475
-------------------------AGGGAGGAGCAGCTAGAAGG|GAATTACTCCTTCTACGTCCTCGACAACC-----------
------SEQUENCER02:110:A815YFABXX:6:1202:18532:53592
-------------------------AGGAGAGGAGCAGCTAGAAGG|GAATTACTCCTTCTACGTCCTCGACAACC-----------
------SEQUENCER02:110:A815YFABXX:6:1203:19185:180694
-------------------------AGGAGAGGAGCAGCTAGAAGG|GAATTACTCTTTCTACGTCCTCGACAACC-----------
------SEQUENCER02:110:A815YFABXX:6:1205:12219:62630
-------------------------AGGAGAGGAGCAGCTAGAAGG|GAATTACTCCTTCTACGTCTTCGACAACC-----------
------SEQUENCER02:110:A815YFABXX:6:1207:18564:151004
-------------------------AGGAGAGGAGCAGCTAGAAGG|GAATTACTCTTTCTACGTCCTCGACAACC-----------
------SEQUENCER02:110:A815YFABXX:6:1208:10113:29806
-------------------------AGGAGAGGAGCAGCTAGAAGG|GAATTACTCCTTCTACGTCCTCGACAACC-----------
------SEQUENCER02:110:A815YFABXX:6:2101:19909:37568
-------------------------AGGAGAGGAGCAGCTAGAAGG|GAATTACTCCTTCTACGTCCTCGACAACC-----------
------SEQUENCER02:110:A815YFABXX:6:2103:6808:175935
-------------------------AGGAGAGGAGCAGCTAGAAGG|GAATTACTCCTTCTACGTCCTCGACAACC-----------
------SEQUENCER02:110:A815YFABXX:6:2106:9113:158949
-------------------------AGGAGAGGAGCAGCTAGAAGG|GAATTACTCCTTCTACGTCCTCGACAACC-----------
------SEQUENCER02:110:A815YFABXX:6:1105:20532:49311
-------------------------AGGAGAGGAGCAGCTAGAAGG|GAATTACTCCTTCTACGTCCTCGACAACC-----------
------SEQUENCER02:110:A815YFABXX:6:1105:9559:138963
-------------------------AGGAGAGGAGCAGCTAGAAGG|GAATTACTCCTTCTACGTCATCGACAACC-----------
------SEQUENCER02:110:A815YFABXX:6:1207:4257:157781
-------------------------AGGAGAGGAGCAGCTAGAAGG|GAATTACTCCTTCTACGTCATCGACAACC-----------
------SEQUENCER02:110:A815YFABXX:6:1208:15221:196853
```

FIGURE 3.40C

```
---------------------------AGGAGAGGAGCAGCTAGAAGG|GAATTACTCCTTCTACGTCCTCGACAACC----
---------SEQUENCER02:110:A815YFABXX:6:2101:20591:66593
---------------------------AGGAGAGGAGCAGCTAGAAGG|GAATTACTCCTTCTACGTCCTCGACAACC----
---------SEQUENCER02:110:A815YFABXX:6:2103:19691:53617
---------------------------AGGAGAGGAGCAGCTAGAAGG|GAATTACTCCTTCTACGTCCTCGACAACC----
---------SEQUENCER02:110:A815YFABXX:6:2107:10075:174768
---------------------------AGGAGAGGAGCAGCTAGAAGG|GAATTGCTCCTTCTACGTCCTCGACAACC----
---------SEQUENCER02:110:A815YFABXX:6:2108:17315:125993
---------------------------AGGAGAGGAGCAGCTAGAAGG|GAATTACTCCTTCTACGTCCTCGACAACC----
---------SEQUENCER02:110:A815YFABXX:6:2201:20854:175279
---------------------------AGGAGAGGAGCAGCTAGAAGG|GAATTACTCCTTCTACGTCATCGACAACC----
---------SEQUENCER02:110:A815YFABXX:6:2208:20522:177259
-------------------------GAGAGGAGCAGCTAGAAGG|GAATTACTCCTTCTACGTCATCGACAACCAG--
---------SEQUENCER02:110:A815YFABXX:6:1108:17165:154214
-------------------------GAGAGGAGCAGCTAGAAGG|GAATTACTCCTTCTACGTCATCGACAACCAG--
---------SEQUENCER02:110:A815YFABXX:6:1208:18105:54965
-------------------------GAGAGGAGCAGCTAGAAGG|GAATTACTCCTTCTACGTCATCGACAACCAG--
---------SEQUENCER02:110:A815YFABXX:6:2106:21269:152225
-------------------------GAGAGGAGCAGCTAGAAGG|GAATTACTCCTTCTACGTCCTCGACAACCAG--
---------SEQUENCER02:110:A815YFABXX:6:2201:5578:28107
-------------------------GAGAGGAGCAGCTAGAAGG|GAATTACTCCTTCTACGTCCTCGATAACCAG--
---------SEQUENCER02:110:A815YFABXX:6:2202:2669:21311
-------------------------GAGAGGAGCAGCTAGAAGG|GAATTACTCCTTCTACGTCCTCGATAACCAG--
---------SEQUENCER02:110:A815YFABXX:6:2205:1917:171292
---------------------------AGGAGCAGCTAGAAGG|GAATTACTCCTTCTACGTCCTCGACAACCAGAAC-
---------SEQUENCER02:110:A815YFABXX:6:1102:1692:178631
---------------------------AGGAGCAGCTAGAAGG|GAATTACTCCTTCTACGTCCTCGACAACCAGAAC-
---------SEQUENCER02:110:A815YFABXX:6:1208:8993:46055
---------------------------AGGAGCAGCTAGAAGG|GAATTACTCCTTCTACGTCCTCGACAACCAGAAC-
---------SEQUENCER02:110:A815YFABXX:6:2201:10712:161293
-----------------------------GGAGCAGCTAGAAGG|GAATTACTCATTCTACGTCCTCGACAACCAGAACT
---------SEQUENCER02:110:A815YFABXX:6:2204:2643:37506
```

FIGURE 3.40D

```
                                                            -------GAGCAGCTAGAAGG|GAATTACTCCTTCTACGTCCTCGACAACCAGAACTT----
                                SEQUENCER02:110:A815YFABXX:6:1206:16320:43111
                                                        ----AGCAGCTAGAAGG|GAATTACTCCTTCTACGTCCTCGACAACCAGAACTT----
                                SEQUENCER02:110:A815YFABXX:6:1106:7347:97752
                                                       -----AGCAGCTAGAAGG|GAATTACTCCTTCTACGTCCTCGACAACCAGAACTTG---
                                SEQUENCER02:110:A815YFABXX:6:1204:21210:35297
                                                       -----AGCAGCTAGAAGG|GAATTACTCCTTCTACGTCCTCGACAACCAGAACTT----
                                SEQUENCER02:110:A815YFABXX:6:1204:8744:170822
                                                       -----AGCAGCTAGAAGG|GAATTACTCCTTCTACGTCCTCGACAACCAGAACTT----
                                SEQUENCER02:110:A815YFABXX:6:1204:9083:165091
                                                       -----AGCAGCTAGAAGG|GAATTACTCCTTCTACGTCCTCGACAACCAGAACTTG---
                                SEQUENCER02:110:A815YFABXX:6:1207:3014:158023
                                                       -----AGCAGCTAGAAGG|GAATTACTCCTTCTACGTCGTCGACAACCAGAACTTG---
                                SEQUENCER02:110:A815YFABXX:6:2101:16264:197638
                                                       -----AGCAGCTAGAAGG|GAATTACTCCTTCTACGTCCTCGACAACCAGAACTT----
                                SEQUENCER02:110:A815YFABXX:6:2106:9626:15103
                                                       -----AGCAGCTAGAAGG|GAATTACTCCTTCTACGTCCTCGACAACCAGAACTTG---
                                SEQUENCER02:110:A815YFABXX:6:2107:12939:160820
                                                       -----AGCAGCTAGAAGG|GAATTACTCCTTCTACGTCCTCGACAACCAGAACTTG---
                                SEQUENCER02:110:A815YFABXX:6:2207:1896:69196
GCAGCTAGAAGG|GAATTACTCCTTCTACGTCCTCGACAACCAGAACTTGC-------
       SEQUENCER02:110:A815YFABXX:6:1207:1769:140262
GCAGCTAGAAGG|GAATTACTCCTTCTACGTCCTCGACAACCAGAACTTGC-------
       SEQUENCER02:110:A815YFABXX:6:2205:14605:104026
TAGAAGG|GAATTACTCCTTCTACGTCCTCGACAACCAGAACTTGCAGCAA-------
       SEQUENCER02:110:A815YFABXX:6:2107:9825:152411
AGAAGG|GAATTACTCCTTCTACGTCCTCGACAACCAGAACTTGCAGCAAC-------
       SEQUENCER02:110:A815YFABXX:6:1105:13553:104957
```

FIGURE 3.40E

```
------------------------------------------------------------------
AGAAGG|GAATTACTTCTTCTACGTCCTCGACAACCAGAACTTGCAGCAAC------
        SEQUENCER02:110:A815YFABXX:6:1108:1841:54857
------------------------------------------------------------------
AGAAGG|GAATTACTCCTTTTACGTCCTCGACAACCAGAACTTGCAGCAAC------
        SEQUENCER02:110:A815YFABXX:6:2105:21092:110675
################################################################

110TTAGGC_6    +chr15:99442850_+chr18:50278424    IGF1R_DCC acceptor_template
*********************************************************************
TTTTGTACTCTCTTCGGAGCTTCCTTGTTCAGCGCGCATCTTCAAGTAACCG|GTTTTCAAATTAAAGCTTTCACAGCACTGCGCTTCCTC
TCAGAACCTTCT  junction_+chr18_49867248_+chr18_50278424_NM_005215
################################################################

110TTAGGC_6    +chr15:99442850_+chr18:50278424    IGF1R_DCC donor_genomic_template
*********************************************************************
TCCTTCCTAAAAAACCTTCGCCTCATCCTAGGAGAGGAGCAGCTAGAAGG|GTAAGTGCCCCAAATTTCATGAGCTGACGTTCTATTAC
AAAATAAGCAGC  junction_+chr15_99442850_NM_000875
        ---TAGGAGAGGAGCAGCTAGAAGG|GTAAGTGCCCCAAATTTCATGAGCTGAC-----
        SEQUENCER02:110:A815YFABXX:6:1107:10854:196494
        ---TAGGAGAGGAGCAGCTAGAAGG|GTAAGTGCCCCAAATTTCATGAGCTGAC-----
        SEQUENCER02:110:A815YFABXX:6:2108:10697:195569
        ---AGGAGAGGAGCAGCTAGAAGG|GTAAGTGCCCCAAATTTCATGAGCTGACG----
        SEQUENCER02:110:A815YFABXX:6:1103:12382:46070
        ---AGGAGAGGAGCAGCTAGAAGG|GTAAGTGCCCCAAATTTCATGAGCTGACG----
        SEQUENCER02:110:A815YFABXX:6:1103:16847:106642
        ---AGGAGAGGAGCAGCTAGAAGG|GTAAGTGTCCCAAATTTCATGAGCTGACG----
        SEQUENCER02:110:A815YFABXX:6:1106:8723:162910
        ---AGGAGAGGAGCAGCTAGAAGG|GTAAGTGCCCCAAATTTCATGAGCTGACG----
        SEQUENCER02:110:A815YFABXX:6:1108:1512:38836
```

FIGURE 3.40F

```
------------    ----------AGGAGAGGAGCAGCTAGAAGG|GTAAGTGTCCCAAATTTCATGAGCTGACG------
------------ SEQUENCER02:110:A815YFABXX:6:1205:2438:46500
------------    ----------AGGAGAGGAGCAGCTAGAAGG|GTAAGTGCCCCAAATTTCATGAGCTGACG------
------------ SEQUENCER02:110:A815YFABXX:6:2101:15521:55556
------------    ----------AGGAGAGGAGCAGTTAGAAGG|GTAAGTGCCCCAAATTTCATGAGCTGACG------
------------ SEQUENCER02:110:A815YFABXX:6:2102:20025:183054
------------    ----------AGGAGAGGAGCAGCTAGAAGG|GTAAGTGCCCCAAATTTCATGAGCTGACG------
------------ SEQUENCER02:110:A815YFABXX:6:2102:9128:188515
------------    ----------AGGAGAGGAGCAGCTAGAAGG|GTAAGTGCCCCAAATTTCATGAGCTGACG------
------------ SEQUENCER02:110:A815YFABXX:6:2104:4343:107226
------------    ----------AGGAGAGGAGCAGCTAGAAGG|GTAAGTGCCCCAAATTTCATGAGCTGACG------
------------ SEQUENCER02:110:A815YFABXX:6:2105:1672:108353
------------    ----------AGGAGAGGAGCAGCTAGAAGG|GTAAGTGCCCCAAATTTCATGAGCTGACG------
------------ SEQUENCER02:110:A815YFABXX:6:2105:17156:83905
------------    ----------AGGAGAGGAGCAGCTAGAAGG|GTAAGTGTCCCAAATTTCATGAGCTGACG------
------------ SEQUENCER02:110:A815YFABXX:6:2107:2082:191967
------------    ----------AGGAGAGGAGCAGCTAGAAGG|GTAAGTGCCCCAAATTTCATGAGCTGACG------
------------ SEQUENCER02:110:A815YFABXX:6:2108:8146:57954
------------    ----------AGGAGAGGAGCAGCTAGAAGG|GTAAGTGTCCCAAATTTCATGAGCTGACG------
------------ SEQUENCER02:110:A815YFABXX:6:2203:10555:42323
------------    ----------AGGAGAGGAGCAGCTAGAAGG|GTAAGTGCCCCAAATTTCATGAGCTGACG------
------------ SEQUENCER02:110:A815YFABXX:6:2205:10449:151696
------------    ----------AGGAGAGGAGCAGCTAGAAGG|GTAAGTGCCCCAAATTTCATGAGCTGACG------
------------ SEQUENCER02:110:A815YFABXX:6:2205:3072:17960
------------    ----------AGGAGAGGAGCAGCTAGAAGG|GTAAGTGCCCCAAATTTCATGAGCTGACG------
------------ SEQUENCER02:110:A815YFABXX:6:2208:15513:46723
------------    ----------AGGAGAGGAGCAGCTAGAAGG|GTAAGTGCCCCAAATTTCATGAGCTGACG------
------------ SEQUENCER02:110:A815YFABXX:6:1104:10743:31591
------------    -------GGAGCAGTTAGAAGG|GTAAGTGCCCCAAATTTCATGAGCTGACG------
------------ SEQUENCER02:110:A815YFABXX:6:1205:18539:12396
------------    -------GGAGCAGTTAGAAGG|GTAAGTGCCCCAAATTTCATGAGCTGACGTTCTAT---
------------ SEQUENCER02:110:A815YFABXX:6:1206:3432:60386
```

FIGURE 3.40G

```
                                                      -----GGAGCAGTTAGAAGG|GTAAGTGCCCCAAATTTCATGAGCTGACGTTCTAT---
                           SEQUENCER02:110:A815YFABXX:6:2105:11728:193117
                                                      -----GGAGCAGTTAGAAGG|GTAAGTGCCCCAAATTTCATGAGCTGACGTTCTAT---
                           SEQUENCER02:110:A815YFABXX:6:2205:10507:18349
                                                      ------AGCAGTTAGAAGG|GTAAGTGCCCCAAATTTCATGAGCTGACGTTCTATT--
                           SEQUENCER02:110:A815YFABXX:6:1108:18690:34208
                                                      ------AGCAGTTAGAAGG|GTAAGTGCCCCAAATTTCATGAGCTGACGTTCTATTA-
                           SEQUENCER02:110:A815YFABXX:6:2101:5017:55310
                                                      ------AGCAGTTAGAAGG|GTAAGTGCCCCAAATTTCATGAGCTGACGTTCTATT--
                           SEQUENCER02:110:A815YFABXX:6:2104:3268:155049
                                                      ------AGCAGTTAGAAGG|GTAAGTGCCCCAAATTTCATGAGCTGACGTTCTATT--
                           SEQUENCER02:110:A815YFABXX:6:2205:13286:96558

GCAGCTAGAAGG|GTAAGTGCTCCAAATTTCATGAGCTGACGTTCTATTAC----------------------------
           SEQUENCER02:110:A815YFABXX:6:1108:3874:30088
GCAGCTAGAAGG|GTAAGTGCTCCAAATTTCATGAGCTGACGTTCTATTAC----------------------------
           SEQUENCER02:110:A815YFABXX:6:2107:11869:76260
GCAGCTAGAAGG|GTAAGTGCTCCAAATTTCATGAGCTGACGTTCTATTAC----------------------------
           SEQUENCER02:110:A815YFABXX:6:2107:14959:94255
GCAGCTAGAAGG|GTAAGTGCTCCAAATTTCATGAGCTGACGTTCTATTAC----------------------------
           SEQUENCER02:110:A815YFABXX:6:2201:16045:123909
GCAGCTAGAAGG|GTAAGTGCTCCAAATTTCATGAGCTGACGTTCTATTAC----------------------------
           SEQUENCER02:110:A815YFABXX:6:2208:9460:104894
CAGCTAGAAGG|GTAAGTGCCCCAAATTTCATGAGCTGACGTTCTATTAC-----------------------------
           SEQUENCER02:110:A815YFABXX:6:1207:11787:24982
CAGCTAGAAGG|GTAAGTGCCCCAAATTTCATGAGCTGACGTTCTATTAC-----------------------------
           SEQUENCER02:110:A815YFABXX:6:2208:9856:4269
```

FIGURE 3.40H

```
AGAAGG|GTAAGTGCCCCAAATTTCATGAGCTGACGTTCTATTACAAAATA-------|
         SEQUENCER02:110:A815YFABXX:6:1101:5518:79510
AGAAGG|GTAAGTGCCCCAAATTTCATGAGCTGACGTTCTATTACAAAATA-------|
         SEQUENCER02:110:A815YFABXX:6:1105:17823:184369
AGAAGG|GTAAGTGCCCCAAATTTCATGAGCTGACGTTCTATTACAAAATA-------|
         SEQUENCER02:110:A815YFABXX:6:2102:13367:60573
AGAAGG|GTAAGTGCCCCAAATTTCATGAGCTGACGTTCTATTACAAAATA-------|
         SEQUENCER02:110:A815YFABXX:6:2103:4492:77515
AGAAGG|GTAAGTGCCCCAAATTTCATGAGCTGACGTTCTATTACAAAATA-------|
         SEQUENCER02:110:A815YFABXX:6:2106:12256:20648
AGAAGG|GTAAGTGCCCCAAATTTCATGAGCTGACGTTCTATTACAAAATA-------|
         SEQUENCER02:110:A815YFABXX:6:2106:8417:179923
AGAAGG|GTAAGTGCCCCAAATTTCATGAGCTGACGTTCTATTACAAAATA-------|
         SEQUENCER02:110:A815YFABXX:6:2108:20772:153076
AGAAGG|GTAAGTGCCCCAAATTTCATGAGCTGACGTTCTATTACAAAATA-------|
         SEQUENCER02:110:A815YFABXX:6:2203:13445:18457
AGAAGG|GTAAGTGCCCCAAATTTCATGAGCTGACGTTCTATTACAAAATA-------|
         SEQUENCER02:110:A815YFABXX:6:2205:16523:4719
AGAAGG|GTAAGTGCCCCAAATTTCATGAGCTGACGTTCTATTACAAAATA-------|
         SEQUENCER02:110:A815YFABXX:6:2208:20514:8984
###############################################################################
#####
110TTAGGC_6    +chr15:99442850_+chr18:50278424    IGF1R_DCC acceptor_genomic_template
```

FIGURE 3.40I

```
********************************************************************
*********
GAGATTTATTTGAATACATGAACATATTCCCTGTGCTCTCTTGTTCCAG|GTTTTCAAATTAAAGCTTTCACAGCACTGCGCTTCCTC
TCAGAACCTTCT   junction +chr18_50278424_NM_005215 ####################################
####################
```

FIGURE 3.40J

3.41 RERG_GZMM

```
111GCCAAT_2        -chr12:15370363_+chr19:547280_RERG_GZMM_fusion_template
***************************************####################################################
TGCGGAGGTCAAACTGGCAATATTTGGGAGAGCAGGCGTGGGCAAGTCAG|GCAGCTCCTTTGGGACCCAGATCATCGGGGGCCGGGAG
GTGATCCCCCAC   junction_-chr12_15370363_+chr19_547280_NM_032918_NM_005317
-------------------CAGGCGTGGGCAAGTCAG|GCAGCTCCTTTGGGACCCAGATCATCGGGGGC------
                   SEQUENCER02:111:B815YKABXX:2:2103:19061:74109
####################***************************************################################
111GCCAAT_2        -chr12:15370363_+chr19:547280_RERG_GZMM_donor_template
***************************************####################################################
TGCGGAGGTCAAACTGGCAATATTTGGGAGAGCAGGCGTGGGCAAGTCAG|CTCTTGTAGTGAGATTTCTGACCAAACGGTTCATCTGG
GAATATGATCCC   junction_-chr12_15370363_-chr12_15274053_NM_032918
-----------------TTGGGAGAGCAGGCGTGGGCAAGTCAG|CTCTTGTAGTGAGATTTCTGACC------
                  SEQUENCER02:111:B815YKABXX:2:1107:10456:27478
-----------------TTGGGAGAGCAGGCGTGGGCAAGTCAG|CTCTTGTAGTGAGATTTCTGACC------
                  SEQUENCER02:111:B815YKABXX:2:2203:1580:60676
-----------------GGGAGAGCAGGCGTGGGCAAGTCAG|CTCTTGTAGTGAGATTTCTGACCAA------
                  SEQUENCER02:111:B815YKABXX:2:1105:15330:58542
-----------------GGGAGAGCAGGCGTGGGCAAGTCAG|CTCTTGTAGTGAGATTTCTGACCAA------
                  SEQUENCER02:111:B815YKABXX:2:2108:14361:30363
-----------------GGGAGAGCAGGCGTGGGCAAGTCAG|CTCTTGTAGTGAGATTTCTGACCAA------
                  SEQUENCER02:111:B815YKABXX:2:2204:7247:170123
```

FIGURE 3.41A

```
-----------------   SEQUENCER02:111:B815YKABXX:2:2206:15020:87848   -GGGAGAGCAGGCGTGGGCAAGTCAG|CTCTTGTAGTGAGATTTTTGACCAA-----
-------------      SEQUENCER02:111:B815YKABXX:2:2206:7943:139218    -GGGAGAGCAGGCGTGGGCAAGTCAG|CTCTTGTAGTGAGATTTCTGACCAA-----
-----              SEQUENCER02:111:B815YKABXX:2:1105:6592:7908      -AGCAGGCGTGGGCAAGTCAG|CTCTTGTAGTGAGATTTCTGGCCAAACGGT------
-----              SEQUENCER02:111:B815YKABXX:2:2102:11882:140600   -AGCAGGCGTGGGCAAGTCAG|CTCTTGTAGTGAGATTTCTGACCAAACGGT------
-----              SEQUENCER02:111:B815YKABXX:2:2106:17164:188728   -AGCAGGCGTGGGCAAGTCAG|CTCTTGTAGTGAGATTTCTGACCAAACGGT------
-----              SEQUENCER02:111:B815YKABXX:2:2108:16112:166022   -AGCAGGCCGTGGGCAAGTCAG|CTCTTGTAGTGAGATTTCTGACCAAATGGT-----
-----              SEQUENCER02:111:B815YKABXX:2:1207:16108:177493   -GCAGGCGTGGGCAAGTCAG|CTCTTGTAGTGAGATTTCTGACCAAACGGTT------
-----              SEQUENCER02:111:B815YKABXX:2:2105:12217:27707    -GCAGGCGTGGGCAAGTCAG|CTCTTGTAGTGAGATTTCTGACCAAACGGTT------
-----              SEQUENCER02:111:B815YKABXX:2:1104:5037:198844    -CAGGCGTGGGCAAGTCAG|CTCTTGTAGTGAGATTTCTGACCAAACGGTTC-------
-----              SEQUENCER02:111:B815YKABXX:2:1203:20817:131176   -CAGGCGTGGGCAAGTCAG|CTCTTGTAGTGAGATTTCTGACCAAACGGTTC-------
-----              SEQUENCER02:111:B815YKABXX:2:1204:10456:180223   -CAGGCGTGGGCAAGTCAG|CTCTTGTAGTGAGATTTCTGACCAAACGGTTC-------
-----              SEQUENCER02:111:B815YKABXX:2:1206:7557:130010    -CAGGCGTGGGCAAGTCAG|CTCTTGTAGTGAGATTTCTGACCAAACGGTTC-------
-----              SEQUENCER02:111:B815YKABXX:2:2101:17602:79103    -CAGGCGTGGGCAAGTCAG|CTCTTGTAGTGAGATTTCTGACCAAACGGTTC-------
-----              SEQUENCER02:111:B815YKABXX:2:2103:10915:116155   -CAGGCGTGGGCAAGTCAG|CTCTTGTAGTGAGATTTCTGACCAAACGGTTC-------
-----              SEQUENCER02:111:B815YKABXX:2:2103:7336:52425     -CAGGCGTGGGCAAGTCAG|CTCTTGTAGTGAGATTTCTGACCAAACGGTTC-------
-----              SEQUENCER02:111:B815YKABXX:2:2103:7940:74733     -CAGGCGTGGGCAAGTCAG|CTCTTGTAGTGAGATTTCTGACCAAACGGTTC-------
```

FIGURE 3.41B

```
------------------CAGGGCGTGGGCAAGTCAG|CTCTTGTAGTGAGATTTCTGACCAAACGGTTC------
------|SEQUENCER02:111:B815YKABXX:2:2103:8894:95920
------------------CAGGGCGTGGGCAAGTCAG|CTCTTGTAGTGAGATTTCTGACCAAACGGTTC------
------|SEQUENCER02:111:B815YKABXX:2:2104:5836:156365
------------------CAGGGCGTGGGCAAGTCAG|CTCTTGTAGTGAGATTTCTGACCAAACGGTTC------
------|SEQUENCER02:111:B815YKABXX:2:2107:13837:17717
------------------CAGGGCGTGGGCAAGTCAG|CTCTTGTAGTGAGATTTCTGACCAAACGGTTC------
------|SEQUENCER02:111:B815YKABXX:2:2202:4325:65916
------------------CAGGGCGTGGGCAAGTCAG|CTCTTGTAGTGAGATTTCTGACCAAACGGTTC------
------|SEQUENCER02:111:B815YKABXX:2:2207:6351:109330
-----------------AGGGCGTGGGCAAGTCAG|CTCTTGTAGTGAGATTTCTGACCAAACGGTTCA------
------|SEQUENCER02:111:B815YKABXX:2:1107:4850:14654
-----------------GGCGTGGGCAAGTCAG|CTCTTGTAGTGAGATTTCTGACCAAACGGTTCAT------
------|SEQUENCER02:111:B815YKABXX:2:1201:10211:77759
-----------------GGCGTGGGCAAGTCAG|CTCTTGTAGTGAGATTTCTGACCAAACGGTTCA------
------|SEQUENCER02:111:B815YKABXX:2:1203:12250:134867
-----------------GGCGTGGGCAAGTCAG|CTCTTGTAGTGAGATTTCTGACCAAACGGTTCA------
------|SEQUENCER02:111:B815YKABXX:2:2204:17028:84816
----------------CGTGGGCAAGTCAG|CTCTTGTAGTGAGATTTCTGACCAAACGGTTCATCT------
------|SEQUENCER02:111:B815YKABXX:2:1104:7962:180850
----------------CGTGGGCAAGTCAG|CTCTTGTAGTGAGATTTCTGACCAAACGGTTCATCT------
------|SEQUENCER02:111:B815YKABXX:2:1106:11087:168114
----------------CGTGGGCAAGTCAG|CTCTTGTAGTGAGATTTCTGACCAAACGGTTTATCT------
------|SEQUENCER02:111:B815YKABXX:2:1202:3689:117930
----------------CGTGGGCAAGTCAG|CTCTTGTAGTGAGATTTCTGACCAAACGGTTCATCT------
------|SEQUENCER02:111:B815YKABXX:2:1206:6340:25202
----------------CGTGGGCAAGTCAG|CTCTTGTAGTGAGATTTCTGACCAAACGGTTCATCT------
------|SEQUENCER02:111:B815YKABXX:2:1207:3880:147792
----------------CGTGGGCAAGTCAG|CTCTTGTAGTGAGATTTCTGACCAAACGGTTCATCT------
------|SEQUENCER02:111:B815YKABXX:2:2102:9477:34144
----------------CGTGGGCAAGTCAG|CTCTTGTAGTGAGATTTCTGACCAAACGGTTCATCT------
------|SEQUENCER02:111:B815YKABXX:2:2207:8343:156553
```

FIGURE 3.41C

```
------------------------------------------------------------------------------GTGGGCAAGTCAG|CTCTTGTAGTGAGATTTCTGACCAAACGGTTCATCT--
                                                                     SEQUENCER02:111:B815YKABXX:2:2103:13577:12998
------------------------------------------------------------------------------GTGGGCAAGTCAG|CTCTTGTAGTGAGATTTCTGACCAAACGGTTCATCTG-
                                                                     SEQUENCER02:111:B815YKABXX:2:2203:11442:8684
------------------------------------------------------------------------------GTGGGCAAGTCAG|CTCTTGTAGTGAGATTTCTGACCAAACGGTTCATCTG-
                                                                     SEQUENCER02:111:B815YKABXX:2:2206:2854:73906
TGGGCAAGTCAG|CTCTTGTAGTGAGATTTCTGACCAAACGGTTCATCTGG------------------------------------
SEQUENCER02:111:B815YKABXX:2:1103:2239:189554
TGGGCAAGTCAG|CTCTTGTAGTGAGATTTCTGACCAAACGGTTCATCTGG------------------------------------
SEQUENCER02:111:B815YKABXX:2:1105:20500:152808
TGGGCAAGTCAG|CTCTTGTAGTGAGATTTCTGACCAAACGGTTCATCTGG------------------------------------
SEQUENCER02:111:B815YKABXX:2:1207:8217:61689
TGGGCAAGTCAG|CTCTTGTAGTGAGATTTCTGACCAAACGGTTCATCTGG------------------------------------
SEQUENCER02:111:B815YKABXX:2:2101:2246:185442
TGGGCAAGTCAG|CTCTTGTAGTGAGATTTCTGACCAAACGGTTCATCTGG------------------------------------
SEQUENCER02:111:B815YKABXX:2:2108:13834:73259
TGGGCAAGTCAG|CTCTTGTAGTGAGATTTCTGACCAAACGGTTCATCTGG------------------------------------
SEQUENCER02:111:B815YKABXX:2:2108:16517:109882
TGGGCAAGTCAG|CTCTTGTAGTGAGATTTCTGACCAAACGGTTCATCTGG------------------------------------
SEQUENCER02:111:B815YKABXX:2:2201:6148:151078
TGGGCAAGTCAG|CTCTTGTAGTGAGATTTCTGACCAAACGGTTCATCTGG------------------------------------
SEQUENCER02:111:B815YKABXX:2:2205:19375:8065
TGGGCAAGTCAG|CTCTTGTAGTGAGATTTCTGACCAAACGGTTCATCTGG------------------------------------
SEQUENCER02:111:B815YKABXX:2:2208:3516:129654
```

FIGURE 3.41D

```
GGGCAAGTCAG|CTCTTGTAGTGAGATTTCTGACCAAACGGTTCATCTGGG------
   SEQUENCER02:111:B815YKABXX:2:1101:12426:120808

GGGCAAGTCAG|CTCTTGTAGTGAGATTTCTGACCAAACGGTTCATCTGGG------
   SEQUENCER02:111:B815YKABXX:2:1105:12949:91805

GGGCAAGTCAG|CTCTTGTAGTGAGATTTCTGACCAAACGGTTCATCTGGG------
   SEQUENCER02:111:B815YKABXX:2:1107:8630:123861

GGGCAAGTCAG|CTCTTGTAGTGAGATTTCTGACCAAACGGTTCATCTGGG------
   SEQUENCER02:111:B815YKABXX:2:1201:13920:146919

GGGCAAGTCAG|CTCTTGTAGTGAGATTTCTGACCAAACGGTTCATCTGGG------
   SEQUENCER02:111:B815YKABXX:2:1201:9663:36515

GGGCAAGTCAG|CTCTTGTAGTGAGATTTCTGACCAAACGGTTCATTTGGG------
   SEQUENCER02:111:B815YKABXX:2:1202:8347:43578

GGGCAAGTCAG|CTCTTGTAGTGAGATTTCTGACCAAACGGTTCATCTGGG------
   SEQUENCER02:111:B815YKABXX:2:1202:8371:96766

GGGCAAGTCAG|CTCTTGTAGTGAGATTTCTGACCAAACGGTTCATCTGGG------
   SEQUENCER02:111:B815YKABXX:2:1203:17225:178501

GGGCAAGTCAG|CTCTTGTAGTGAGATTTCTGACCAAACGGTTCATCTGGG------
   SEQUENCER02:111:B815YKABXX:2:1206:13396:154295

GGGCAAGTCAG|CTCTTGTAGTGAGATTTCTGACCAAACGGTTCACCTGGG------
   SEQUENCER02:111:B815YKABXX:2:1207:14769:182254

GGGCAAGTCAG|CTCTTGTAGTGAGATTTCTGACCAAACGGTTCATCTGGG------
   SEQUENCER02:111:B815YKABXX:2:1207:1884:98057
```

FIGURE 3.41E

```
                 --------GGGCAAGTCAG|CTCTTGTAGTGAGATTTCTGACCAAACGGATCATCTGGG-------------------
                         SEQUENCER02:111:B815YKABXX:2:1208:7756:159344
                 --------GGGCAAGTCAG|CTCTTGTAGTGAGATTTCTGACCAAACGGTTCATCTGGG-------------------
                         SEQUENCER02:111:B815YKABXX:2:2103:11639:127408
                 --------GGGCAAGTCAG|CTCTTGTAGTGAGATTTCTGACCAAACGGTTCATCTGGG-------------------
                         SEQUENCER02:111:B815YKABXX:2:2108:11524:167612
                 --------GGGCAAGTCAG|CTCTTGTAGTGAGATTTCTGACCAAACGGTTCATCTGGG-------------------
                         SEQUENCER02:111:B815YKABXX:2:2108:15537:9000
                 --------GGGCAAGTCAG|CTCTTGTAGTGAGATTTCTGACCAAACGGTTCATCTGGG-------------------
                         SEQUENCER02:111:B815YKABXX:2:2205:17859:13771
                 --------GGGCAAGTCAG|CTCTTGTAGTGAGATTTCTGACCAAACGGTTCATCTGGG-------------------
                         SEQUENCER02:111:B815YKABXX:2:2206:6399:34655
                 --------GGGCAAGTCAG|CTCTTGTAGTGAGATTTCTGACCAAACGGTTCATCTGG--------------------
                         SEQUENCER02:111:B815YKABXX:2:2206:9103:32816
                 --------GGGCAAGTCAG|CTCTTGTAGTGAGATTTCTGACCAAACGGTTCATCTGGG-------------------
                         SEQUENCER02:111:B815YKABXX:2:2207:5312:198297
                 --------GGGCAAGTCAG|CTCTTGTAGTGAGATTTCTGACCAAACGGTTCATTTGGG-------------------
                         SEQUENCER02:111:B815YKABXX:2:2208:13669:77244
##############################################################################################
111GCCAAT_2      -chr12:153703630_+chr19:547280 RERG_GZMM acceptor_template
**********************************************************************************************
```

FIGURE 3.41F

```
GGCCTGCGTGTCTTCACTGCTGCTGGTGCTGGCCCTGGGGCCCTGTCAGTAG|GCAGCTCCTTTGGGACCCAGATCATCGGGGCCGGGAG
GTGATCCCCCAC   junction +chr19_544126_+chr19_547280_NM_005317
###############################################################################################
111GCCAAT_2   -chr12:15370363_+chr19:547280_RERG_GZMM_donor_genomic_template
*************
TGCGGGAGGTCAAACTGGCAATATTT|GGGAGAGCAGGCCTGGGCAAGTCAG|GTAAGATTTTCGTTGTGGTTGTGGTTGTTATAGTGTGTGTGT
GGGTGAGTGTGT   junction -chr12_15370363_NM_032918
------------   -----TGGGAGAGCAGGCCGTGGGCAAGTCAG|GTAAGATTTTCGTTGTGGTTGTTA----
------------   SEQUENCER02:111:B815YKABXX:2:1103:2896:200142
------------   -----TGGGAGAGCAGGCCGTGGGCAAGTCAG|GTAAGATTTTCGTTGTGGTTGTTA----
------------   SEQUENCER02:111:B815YKABXX:2:1108:6039:11621
------------   -----TGGGAGAGCAGGCCGTGGGCAAGTCAG|GTAAGATTTTCGTTGTGGTTGTTA----
------------   SEQUENCER02:111:B815YKABXX:2:1205:17292:78936
------------   -----TGGGAGAGCAGGCCGTGGGCAAGTCAG|GTAAGATTTTCGTTGTGGTTGTTA----
------------   SEQUENCER02:111:B815YKABXX:2:2108:12087:94071
------------   -----TGGGAGAGCAGGCCGTGGGCAAGTCAG|GTAAGATTTTCGTTGTGGTTGTTA----
------------   SEQUENCER02:111:B815YKABXX:2:2204:17991:41519
------------   -----GGGAGAGCAGGCCGTGGGCAAGTCAG|GTAAGATTTTCGTTGTGGTTGTTAT---
------------   SEQUENCER02:111:B815YKABXX:2:1108:9528:89417
------------   -----GGGAGAGCAGGCCGTGGGCAAGTCAG|GTAAGATTTTCGTTGTGGTTGTTAT---
------------   SEQUENCER02:111:B815YKABXX:2:2101:13782:196733
------------   -----GGGAGAGCAGGCCGTGGGCAAGTCAG|GTAAGATTTTCGTTGTGGTTGTTAT---
------------   SEQUENCER02:111:B815YKABXX:2:2104:5728:47239
------------   -----GGGAGAGCAGGCCGTGGGCAAGTCAG|GTAAGATTTTCGTTGTGGTTGTTAT---
------------   SEQUENCER02:111:B815YKABXX:2:2205:4638:143556
------------   -----GGGAGAGCAGGCCGTGGGCAAGTCAG|GTAAGATTTTTCGTTGTGGTTGTTAT--
------------   SEQUENCER02:111:B815YKABXX:2:2208:7772:52463
------------   -------GAGCAGGCCGTGGGCAAGTCAG|GTAAGATTTTCGTTGTGGTTGTTATAGT-
------------   SEQUENCER02:111:B815YKABXX:2:2202:2246:73756
------------   ----AGCAGGCCGTGGGCAAGTCAG|GTAAGATTTTCGTTGTGGTTGTTATAGTGT--
------------   SEQUENCER02:111:B815YKABXX:2:1202:15904:154034
```

FIGURE 3.41G

```
------------SEQUENCER02:111:B815YKABXX:2:2106:6166:110055   ------------AGCAGGCGTGGGCAAGTCAG|GTAAGATTTTCGTTGTTGGTTGTTATAGTGT---
------------SEQUENCER02:111:B815YKABXX:2:2208:8377:122252   ------------AGCAGGCGTGGGCAAGTCAG|GTAAGATTTTCGTTGTTGGTTGTTATAGTGT---
------------SEQUENCER02:111:B815YKABXX:2:1108:14153:12297   -----------GCAGGCGTGGGCAAGTCAG|GTAAGATTTTCGTTGTTGGTTGTTATAGTGTG---
------------SEQUENCER02:111:B815YKABXX:2:1201:20128:94611   -----------GCAGGCGTGGGCAAGTCAG|GTAAGATTTTCGTTGTTGGTTGTTATAGTGTG---
------------SEQUENCER02:111:B815YKABXX:2:2101:11957:136874  -----------GCAGGCGTGGGCAAGTCAG|GTAAGATTTTCGTTGTTGGTTGTTATAGTGTG---
------------SEQUENCER02:111:B815YKABXX:2:2101:19012:117778  -----------GCAGGCGTGGGCAAGTCAG|GTAAGATTTTCGTTGTTGGTTGTTATAGTGTG---
------------SEQUENCER02:111:B815YKABXX:2:2204:4161:157314   -----------GCAGGCGTGGGCAAGTCAG|GTAAGATTTTCGTTGTGGTTGTTATAGTGTG---
------------SEQUENCER02:111:B815YKABXX:2:1104:2115:127711   ------------CAGGCGTGGGCAAGTCAG|GTAAGATTTTCGTTGTTGGTTGTTATAGTGTG---
------------SEQUENCER02:111:B815YKABXX:2:1201:16244:56308   ------------CAGGCGTGGGCAAGTCAG|GTAAGATTTTCGTTGTTGGTTGTTATAGTGTG---
------------SEQUENCER02:111:B815YKABXX:2:1204:9440:23290    ------------CAGGCGTGGGCAAGTCAG|GTAAGATTTTCGTTGTTGGTTGTTATAGTGTGT--
------------SEQUENCER02:111:B815YKABXX:2:2102:4763:200222   ------------CAGGCGTGGGCAAGTCAG|GTAAGATTTTCGTTGTTGGTTGTTATAGTGTG---
------------SEQUENCER02:111:B815YKABXX:2:2204:13408:77819   ------------CAGGCGTGGGCAAGTCAG|GTAAGATTTTCGTTGTTGGTTGTTATAGTGTG---
------------SEQUENCER02:111:B815YKABXX:2:2208:21338:180342  ------------CAGGCGTGGGCAAGTCAG|GTAAGATTTTCGTTGTTGGTTGTTATAGTGTG---
------------SEQUENCER02:111:B815YKABXX:2:2208:19701:196224  -----------AGGCGTGGGCAAGTCAG|GTAAGATTTTCGTTGTTGGTTGTTATAGTGTG---
------------SEQUENCER02:111:B815YKABXX:2:1206:8931:79799    -----------GCGTGGGCAAGTCAG|GTAAGATTTTCGTTGTTGGTTGTTATAGTGTGTG---
------------SEQUENCER02:111:B815YKABXX:2:2201:4406:169965   -----------GCGTGGGCAAGTCAG|GTAAGATTTTCGTTGTTGGTTGTTATAGTGTGTG---
```

FIGURE 3.41H

```
                                                       -CGTGGGCAAGTCAG|GTAAGATTTTCGTTGTGGTTGTGTTATAGTGTGTGTGT-
                                   SEQUENCER02:111:B815YKABXX:2:2207:4714:82738
                                                       -GTGGGCAAGTCAG|GTAAGATTTTCGTTGTGGTTGTGTTATAGTGTGGGTGTG-
                                   SEQUENCER02:111:B815YKABXX:2:1204:3144:26686
                                                       -GTGGGCAAGTCAG|GTAAGATTTTCGTTGTGGTTGTGTTATAGTGTGTGTGTG-
                                   SEQUENCER02:111:B815YKABXX:2:1206:10717:179254

GGGCAAGTCAG|GTAAGATTTTCGTTGTGGTTGTGTTATAGTGTGTGTGCGTG-
       SEQUENCER02:111:B815YKABXX:2:1101:3113:53093
GGGCAAGTCAG|GTAAGATTTTCGTTGTGGTTGTGTTATAGTGTGTGTGTGTG-
       SEQUENCER02:111:B815YKABXX:2:1104:20228:41336
GGGCAAGTCAG|GTAAGATTTTCGTTGTGGTTGTGTTATAGTGTGTGTGTGTG-
       SEQUENCER02:111:B815YKABXX:2:1104:3885:184928
GGGCAAGTCAG|GTAAGATTTTCGTTGTGGTTGTGTTATAGTGTGTGTGTGTG-
       SEQUENCER02:111:B815YKABXX:2:1105:18663:109514
GGGCAAGTCAG|GTAAGATTTTCGTTGTGGTTGTGTTATAGTGTGTGTGTGTG-
       SEQUENCER02:111:B815YKABXX:2:1105:5441:126264
GGGCAAGTCAG|GTAAGATTTTCGTTGTGGTTGTGTTATAGTGTGTGTGTGTG-
       SEQUENCER02:111:B815YKABXX:2:1107:19006:74423
GGGCAAGTCAG|GTAAGATTTTCGTTGTGGTTGTGTTATAGTGTGTGTGTGTG-
       SEQUENCER02:111:B815YKABXX:2:1107:7784:186883
GGGCAAGTCAG|GTAAGATTTTCGTTGTGGTTGTGTTATAGTGTGTGTGTGTG-
       SEQUENCER02:111:B815YKABXX:2:1107:8973:140627
GGGCAAGTCAG|GTAAGATTTTCGTTGTGGTCGTTATAGTGTGTGTGTGTG-
       SEQUENCER02:111:B815YKABXX:2:1108:14525:127401
```

FIGURE 3.41I

```
----------------------------------GGGCAAGTCAG|GTAAGATTTCGTTGTGTTGGTTGTTATAGTGTGTGTGTG---------------------------------------
                                  SEQUENCER02:111:B815YKABXX:2:1108:7536:162809
------------------------------------------GGGCAAGTCAG|GTAAGATTTCGTTGTGTTGGTTGTTATAGTGTGTGTG---------------------------------
                                          SEQUENCER02:111:B815YKABXX:2:1202:7072:179184
GGGCAAGTCAG|GTAAGATTTCGTTGTGTTGGTTGTTATAGTGTGTGTGTG---------------------------------------
SEQUENCER02:111:B815YKABXX:2:1203:3642:72756
GGGCAAGTCAG|GTAAGATTTCGTTGTGTTGGTTGTTATAGTGTGTGTGTG---------------------------------------
SEQUENCER02:111:B815YKABXX:2:1204:15393:43230
GGGCAAGTCAG|GTAAGATTTCGTTGTGTTGGTTGTTATAGTGTGTGTGTG---------------------------------------
SEQUENCER02:111:B815YKABXX:2:1208:10439:36327
GGGCAAGTCAG|GTAAGATTTCGTTGTGTTGGTTGTTATAGTGTGTGTGTG---------------------------------------
SEQUENCER02:111:B815YKABXX:2:1208:17377:89674
GGGCAAGTCAG|GTAAGATTTCGTTGTGTTGGTTGTTATAGTGTGTGTGTG---------------------------------------
SEQUENCER02:111:B815YKABXX:2:2103:7073:92220
GGGCAAGTCAG|GTAAGATTTCGTTGTGTTGGTTGTTATAGTGTGTGTGTG---------------------------------------
SEQUENCER02:111:B815YKABXX:2:2105:1765:197380
GGGTAAGTCAG|GTAAGATTTCGTTGTGTTGGTTGTTATAGTGTGTGTGTG---------------------------------------
SEQUENCER02:111:B815YKABXX:2:2106:3239:118865
GGGCAAGTCAG|GTAAGATTTCGTTGTGTTGGTTGTTATAGTGTGTGTGTG---------------------------------------
SEQUENCER02:111:B815YKABXX:2:2203:13204:132355
GGGCAAGTCAG|GTAAGATTTCGTTGTGTTGGTTGTTATAGTGTGTGTGTG---------------------------------------
SEQUENCER02:111:B815YKABXX:2:2204:19475:34729
```

FIGURE 3.41J

```
GGGCAAGTCAG|GTAAGATTTTCGTTGTGGTTGTTATAGTGTGTGTGTG------------
          SEQUENCER02:111:B815YKABXX:2:2207:12435:68227
          ----------
GGGCAAGTCAG|GTAAGATTTTCGTTGTGGTTGTTATAGTGTGTGTGTG------------
          SEQUENCER02:111:B815YKABXX:2:2207:4340:149784
          ----------
GGGCAAGTCAG|GTAAGATTTTCGTTGTGGTTGTTATAGTGTGTGTGTG------------
          SEQUENCER02:111:B815YKABXX:2:2207:4354:47982
          ----------
GGGCAAGTCAG|GTAAGATTTTCGTTGTGGTTGTTATAGTGTGTGTGTG------------
          SEQUENCER02:111:B815YKABXX:2:2208:8506:53420
          ----------
GGCAAGTCAG|GTAAGATTTTCGTTGTGGTTGTTATAGTGTGTGTGTGG-----------
          SEQUENCER02:111:B815YKABXX:2:1208:9378:117942
          ----------
GCAAGTCAG|GTAAGATTTTCGTTGTGGTTGTTATAGTGTGTGTGTG------------
         SEQUENCER02:111:B815YKABXX:2:2204:7914:10928
         ##########
111GCCAAT_2    -chr12:153703632_+chr19:547280 RERG_GZMM acceptor_genomic_template
         **********
         *****
```

FIGURE 3.41K

```
3.42 TPP2_BRCA2
111GCCAAT_2    +chr13:103249553_+chr13:32890559   TPP2_BRCA2   fusion_template
         ****************************************************************
CAGCAGGGGCATGTAGCCCCAACCTGGCTCTTTGTCCCCATCCTGGCAG|GCAGCTCCTTTGGGACCAGATCATCGGGGCCGGGAG
         junction_+chr19_547280_NM_005317
GTGATCCCCCAC
         ****************************************************************
         **********
```

FIGURE 3.42A

```
TCATCGCAGTCCTGGACACGGGGTCGACCCGGGGGCTCCGGGCATGCAG|ACTTATTTACCAAGCATTGGAGGAATATCGTAGGTAAA
AATGCCTATTGG     junction_+chr13_103249553_+chr13_32890559_NM_000059----------------------
------------     ----CGGGGGTCGACCCGGGGGCTCCGGGCATGCAG|ACTTATTTACCAAACATT--------------------
------------     SEQUENCER02:111:B815YKABXX:2:2107:20897:128035
------------     -----GGGGTCGACCCGGGGGCTCCGGGCATGCAG|ACTTATTTACCAAACATTGG-------------------
------------     SEQUENCER02:111:B815YKABXX:2:1206:17262:187897
------------     -----GGGGTCGACCCGGGGGCTCCGGGCATGCAG|ACTTATTTACCAAACATTGG-------------------
------------     SEQUENCER02:111:B815YKABXX:2:1207:7126:48800
------------     -----GGGGTCGACCCGGGGGCTCCGGGCATGCAG|ACTTATTTACCAAACATTGG-------------------
------------     SEQUENCER02:111:B815YKABXX:2:2206:3708:58619
############################################################################################
############
111GCCAAT_2   +chr13:103249553_+chr13:32890559    TPP2_BRCA2    donor_template
*********************************************************************************************

TCATCGCAGTCCTGGACACGGGGTCGACCCGGGGGCTCCGGGCATGCAG|GTTACAACTGATGGAAAACCAAAAATCGTTGATATCAT
TGATACAACAGG     junction_+chr13_103249553_+chr13_103257143_NM_003291---------------------
------------     ---ACGGGGGTCGACCCGGGGGCTCCGGGCATGCAG|GTTACAACTGATGGAAA--------------------
------------     SEQUENCER02:111:B815YKABXX:2:1201:9020:67833
------------     ---ACGGGGGTCGACCCGGGGGCTCCGGGCATGCAG|GTTACAACTGATGGAAA--------------------
------------     SEQUENCER02:111:B815YKABXX:2:2102:15193:106135
------------     ---CGGGGGTCGACCCGGGGGCTCCGGGCATGCAG|GTTACAACTGATGGAAA--------------------
------------     SEQUENCER02:111:B815YKABXX:2:1102:18810:194431
------------     ---CGGGGGTCGACCCGGGGGCTCCGGGCATGCAG|GTTACAACTGATGGAAA--------------------
------------     SEQUENCER02:111:B815YKABXX:2:1204:19494:25948
------------     ----GGGGGTCGACCCGGGGGCTCCGGGCATGCAG|GTTACAACTGATGGAAAAC-------------------
------------     SEQUENCER02:111:B815YKABXX:2:1101:14370:56969
------------     ----GGGGGTCGACCCGGGGGCTCCGGGCATGCAG|GTTACAACTGATGGAAA--------------------
------------     SEQUENCER02:111:B815YKABXX:2:1103:1918:44191
------------     ----GGGGGTCGACCCGGGGGCTCCGGGCATGCAG|GTTACAACTGATGGAAA--------------------
------------     SEQUENCER02:111:B815YKABXX:2:1104:9424:1037787
------------     ----GGGGGTCGACCCGGGGGCTCCGGGCATGCAG|GTTACAACTGATGGAAAAC-------------------
------------     SEQUENCER02:111:B815YKABXX:2:1105:13140:174657
```

FIGURE 3.42B

```
------------------------------GGGGGTCGACCCGGGGGGCTCCGGGCATGCAG|GTTACAACTGATGGAAAAC------
------SEQUENCER02:111:B815YKABXX:2:1201:12914:156509
------SEQUENCER02:111:B815YKABXX:2:1203:20698:83155
------SEQUENCER02:111:B815YKABXX:2:1207:18831:117112
------SEQUENCER02:111:B815YKABXX:2:1207:6781:35670
------SEQUENCER02:111:B815YKABXX:2:2104:12692:129336
------SEQUENCER02:111:B815YKABXX:2:2104:12961:67358
------SEQUENCER02:111:B815YKABXX:2:2106:6413:33597
------SEQUENCER02:111:B815YKABXX:2:2202:16825:100755
------SEQUENCER02:111:B815YKABXX:2:2207:17528:55132
------SEQUENCER02:111:B815YKABXX:2:1104:11604:62016
------SEQUENCER02:111:B815YKABXX:2:1202:17045:58136
------SEQUENCER02:111:B815YKABXX:2:1206:9456:153433
------SEQUENCER02:111:B815YKABXX:2:2103:14976:70233
------SEQUENCER02:111:B815YKABXX:2:2106:9242:31325
------SEQUENCER02:111:B815YKABXX:2:2208:17818:136959
------SEQUENCER02:111:B815YKABXX:2:1202:9408:131142
```

FIGURE 3.42C

```
                                              -------GGGACTCCGGGCATGCAG|GTTACAACTGATGGAAAACCAAAAATCGTTGA-------
                                              SEQUENCER02:111:B815YKABXX:2:1207:15691:90122
                                              -------GGGGCTCCGGGCATGCAG|GTTACAACTGATGGAAAACCAAAAATCGTTGA-------
                                              SEQUENCER02:111:B815YKABXX:2:2106:12267:13867
                                              -------GGGGCTCCGGGCATGCAG|GTTACAACTGATGGAAAACCAAAAATCGTTGA-------
                                              SEQUENCER02:111:B815YKABXX:2:2107:5427:48889
CCGGGCATGCAG|GTTACAACTGATGGAAAACCAAAAATCGTTGATATCAT-------
SEQUENCER02:111:B815YKABXX:2:1104:21009:180342
CCGGGCATGCAG|GTTACAACTGATGGAAAACCAAAAATCGTTGATATCAT-------
SEQUENCER02:111:B815YKABXX:2:1105:111113:168410
CCGGGCATGCAG|GTTACAACTGATGGAAAACCAAAAATCGTTGATATCAT-------
SEQUENCER02:111:B815YKABXX:2:1105:6063:90890
CCGGGCATGCAG|GTTACAACTGATGGAAAACCAAAAATCGTTGATATCAT-------
SEQUENCER02:111:B815YKABXX:2:1202:14828:63482
CCGGGCATGCAG|GTTACAACTGATGGAAAACCAAAAATCGTTGATATCAT-------
SEQUENCER02:111:B815YKABXX:2:2202:6784:17293
CGGGCATGCAG|GTTACAACTGATGGAAAACCAAAAATCGTTGATATCAT-------
SEQUENCER02:111:B815YKABXX:2:1104:15020:178798
CGGGCATGCAG|GTTACAACTGATGGAAAACCAAAAATCGTTGATATCAT-------
SEQUENCER02:111:B815YKABXX:2:2106:4462:160470
CGGGCATGCAG|GTTACAACTGATGGAAAACCAAAAATCGTTGATATCAT-------
SEQUENCER02:111:B815YKABXX:2:2207:8771:124415
GGCATGCAG|GTTACAACTGATGGAAAACCAAAAATCGTTGATATCATTGA------
SEQUENCER02:111:B815YKABXX:2:2108:16880:198315
```

FIGURE 3.42D

```
GGCATGCAG|GTTACAACTGATGGAAAAACCAAAAAATCGTTGATATCATTGA-------
         SEQUENCER02:111:B815YKABXX:2:2201:19063:3857
GGCATGCAG|GTTACAACTGATGGAAAAACCAAAAAATCGTTGATATCATTGA-------
         SEQUENCER02:111:B815YKABXX:2:2207:9998:99281
GGCATGCAG|GTTACAACTGATGGAAAAACCAAAAAATCGTTGATATCATTGA-------
         SEQUENCER02:111:B815YKABXX:2:2208:11857:155864
GGCATGCAG|GTTACAACTGATGGAAAAACCAAAAAATCGTTGATATCATTGA-------
         SEQUENCER02:111:B815YKABXX:2:2208:12746:182491
CATGCAG|GTTACAACTGATGGAAAAACCAAAAAATCGTTGATATCATTGATA-------
       SEQUENCER02:111:B815YKABXX:2:1105:2631:105426
CATGCAG|GTTACAACTGATGGAAAAACCAAAAAATCGTTGATATCATTGATA-------
       SEQUENCER02:111:B815YKABXX:2:1107:20374:64954
CATGCAG|GTTACAACTGATGGAAAAACCAAAAAATCGTTGATATCATTGATA-------
       SEQUENCER02:111:B815YKABXX:2:1108:17497:109860
CATGCAG|GTTACAACTGATGGAAAAACCAAAAAATCGTTGATATCATTGATA-------
       SEQUENCER02:111:B815YKABXX:2:1208:12707:123059
CATGCAG|GTTACAACTGATGGAAAAACCAAAAAATCGTTGATATCATTGATA-------
       SEQUENCER02:111:B815YKABXX:2:2204:14605:35831
TGCAG|GTTACAACTGATGGAAAAACCAAAAAATCGTTGATATCATTGATAC--------
     SEQUENCER02:111:B815YKABXX:2:2207:3452:196657
##############################################################
############
111GCCAAT_2    +chr13:103249553_+chr13:32890559    TPP2_BRCA2    acceptor_template
```

FIGURE 3.42E

```
************************************************
******************
GGTTTTTGTCAGCTTACTCCGGCCAAAAAAGAACTGCACCTCTGGAGCGG|ACTTATTTACCAAGCATTGGAGGAATATCGTAGGTAAA
AATGCCTATTGG    junction +chr13_32889804_+chr13_32890559 NM_000059
###############################################################################
111GCCAAT_2     +chr13:103249553_+chr13:32890559     TPP2_BRCA2    donor_genomic_template
*****************************************************************
TCATCGCAGTCCTGACACGGGGTCGACCCCGGGGCTCCGGGCATGCAG|GTGAGGCGGCCCCCGAGGGCCCGGGCGCGGGGGCGGG
GCGGCCGGGAC    junction +chr13_103249553_NM_003291
###############################################################################
111GCCAAT_2     +chr13:103249553_+chr13:32890559     TPP2_BRCA2
      acceptor_genomic_template
*****************************************************************
AATAAGGAATGCATCCCTGTGTAAGTGCATTTGGTCTTCTTCTGTTTTGCAG|ACTTATTTACCAAGCATTGGAGGAATATCGTAGGTAAA
AATGCCTATTGG    junction +chr13_32890559_NM_000059
###############################################################################
```

FIGURE 3.42F

```
3.43 UTP23_RAD21
111GCCAAT_4     +chr8:117779030_-chr8:117879000     UTP23_RAD21    fusion_template
**********************************************************
GAGCAGCAGCTGCCCCCGCTACCTCATGGGGAGACGCAGCTGTGCACCACAAG|GTTTTCTTCTGTTTTCATAGCCAGCCAGAACAATGTTC
TACGCACATTTT    junction +chr8_117779030_-chr8_117879000_NM_032334 NM_006265
---------GGGGAGACGCAGCTGTGCACCACAAG|GTTTTCTTCTGTTTTCATAGCCA-----
             SEQUENCER02:111:B815YKABXX:4:1106:13543:122027
---------GGGGAGACGCAGCTGTGCACCACAAG|GTTTTCTTCTGTTTTCATAGCCA-----
             SEQUENCER02:111:B815YKABXX:4:1108:15268:163957
```

```
###################################################################################
##############
111GCCAAT_4   +chr8:117779030_-chr8:117879000    UTP23_RAD21
         acceptor_genomic_template
**************************************************************************
***********
TATTTAAATTGTCAGATGATGTTACATTAACTTTTTTTCCCCTCTTAG|GTTTTCTTCTGTTTTCATAGCCAGCCAGAACAATGTTC
TACGCACATTTT    junction_-chr8_117879000_NM_006265
###################################################################################
##############
```

FIGURE 3.43C

3.44 ERBB2_IKZF3

```
111GCCAAT_5   +chr17:37866134_-chr17:37949186    ERBB2_IKZF3   fusion_template
**************************************************************************************
GTGTAAGGGCTCCCGCTGCTGGGAGAGAGTTCTGAGGATTGTCAGAGCC|ATGATTCAATGAAAGTGAAAGATGAATACAGTGAAAGA
GATGAGAATGTT   junction_+chr17_37866134_-chr17_37949186_NM_004448_NM_012481
-----------GGGGAGAGAGTTCTGAGGATTGTCAGAGCC|ATGATTCAATGAAA-----------------------
            SEQUENCER02:111:B815YKABXX:5:1104:8373:117283
------------GGGGAGAGAGTTCTGAGGATTGTCAGAGCC|ATGATTCAATGAAA-----------------------
            SEQUENCER02:111:B815YKABXX:5:2102:14813:114842
------------GGGGAGAGAGTTCTGAGGATTGTCAGAGCC|ATGATTCAATGAAA-----------------------
            SEQUENCER02:111:B815YKABXX:5:2208:3079:164466
-----------GGGTAGAGAGTTCTGAGGATTGTCAGAGCC|ATGATTCAATGAAA-----------------------
            SEQUENCER02:111:B815YKABXX:5:2208:3308:148058
###################################################################################
##############
111GCCAAT_5   +chr17:37866134_-chr17:37949186    ERBB2_IKZF3   donor_template
**************************************************************************************
GTGTAAGGGCTCCCGCTGCTGGGAGAGAGTTCTGAGGATTGTCAGAGCC|TGACGCGCACTGTCTGTGCCGGTGGCTGTGCCCGCTGC
AAGGGGCCACTG   junction_+chr17_37866134_NM_004448
```

FIGURE 3.44A

```
------------GCTGGGGAGAGAGTTCTGAGGATTGTCAGAGCC|TGACGCGCACTGTCTGT------------
------------SEQUENCER02:111:B815YKABXX:5:1102:7244:105785
------------GCTGGGGAGAGAGTTCTGAGGATTGTCAGAGCC|TGACGCGCACTGTCTGT------------
------------SEQUENCER02:111:B815YKABXX:5:1103:1865:67510
------------GCTGGGGAGAGAGTTCTGAGGATTGTTAGAGCC|TGACGCGCACTGTCTGT------------
------------SEQUENCER02:111:B815YKABXX:5:1105:15778:3571
------------GCTGGGGAGAGAGTTCTGAGGATTGTCAGAGCC|TGACGCGCACTGTCTGT------------
------------SEQUENCER02:111:B815YKABXX:5:1108:16784:64377
------------GCTGGGGAGAGAGTTCTGAGGATTGTCAGAGCC|TGACGCGCACTGTCTGT------------
------------SEQUENCER02:111:B815YKABXX:5:1108:7518:130696
------------GCTGGGGAGAGAGTTCTGAGGATTGTCAGAGCC|TGACGCGCACTGTCTGT------------
------------SEQUENCER02:111:B815YKABXX:5:1202:6752:123161
------------GCTGGGGAGAGAGTTCTGAGGATTGTCAGAGCC|TGACGCGCACTGTCTGT------------
------------SEQUENCER02:111:B815YKABXX:5:1205:20364:128255
------------GCTGGGGAGAGAGTTCTGAGGATTGTCAGAGCC|TGACGCGCACTGTCTGTCTG-------
------------SEQUENCER02:111:B815YKABXX:5:1206:10812:177530
------------GCTGGGGAGAGAGTTCTGAGGATTGTCAGAGCC|TGACGCGCACTGTCTGT------------
------------SEQUENCER02:111:B815YKABXX:5:1206:11254:22180
------------GCTGGGGAGAGAGTTCTGAGGATTGTCAGAGCC|TGACGCGCACTGTCTGT------------
------------SEQUENCER02:111:B815YKABXX:5:1206:13683:169450
------------GCTGGGGAGAGAGTTCTGAGGATTGTTAGAGCC|TGACGCGCACTGTCTGT------------
------------SEQUENCER02:111:B815YKABXX:5:1206:14061:182289
------------GCTGGGGAGAGAGTTCTGAGGATTGTCAGAGCC|TGACGCGCACTGTCTGT------------
------------SEQUENCER02:111:B815YKABXX:5:1207:14545:60717
------------GCTGGGGAGAGAGTTCTGAGGATTGTTAGAGCC|TGACGCGCACTGTCTGT------------
------------SEQUENCER02:111:B815YKABXX:5:2101:3429:125473
------------GCTGGGGAGAGAGTTCTGAGGATTGTTAGAGCC|TGACGCGCACTGTCTGT------------
------------SEQUENCER02:111:B815YKABXX:5:2101:3550:183885
------------GCTGGGGAGAGAGTTCTGAGGATTGTCAGAGCC|TGACGCGCACTGTCTGT------------
------------SEQUENCER02:111:B815YKABXX:5:2101:7282:131098
------------GCTGGGGAGAGAGTTCTGAGGATTGTCAGAGCC|TGACGCGCACTGTCTGT------------
------------SEQUENCER02:111:B815YKABXX:5:2101:9824:83408
```

FIGURE 3.44B

```
----GCTGGGGAGAGAGTTCTGAGGATTGTTAGAGCC|TGACGCGCACTGTCTGT----
----SEQUENCER02:111:B815YKABXX:5:2103:18025:82671
----GCTGGGGAGAGAGTTCTGAGGATTGTTAGAGCC|TGACGCGCACTGTCTGT----
----SEQUENCER02:111:B815YKABXX:5:2104:12485:65659
----GCTGGGGAGAGAGTTCTGAGGATTGTCAGAGCC|TGACGCGCACTGTCTGT----
----SEQUENCER02:111:B815YKABXX:5:2201:10730:55447
----GCTGGGGAGAGAGTTCTGAGGATTGTCAGAGCC|TGACGCGCACTGTCTGT----
----SEQUENCER02:111:B815YKABXX:5:2203:6627:70516
----GCTGGGGAGAGAGTTCTGAGGATTGTCAGAGCC|TGACGCGCACTGTCTGT----
----SEQUENCER02:111:B815YKABXX:5:2205:20158:13392
----GCTGGGGAGAGAGTTCTGAGGATTGTCAGAGCC|TGACGCGCACTGTCTGT----
----SEQUENCER02:111:B815YKABXX:5:2206:1418:39302
----GCTGGGGAGAGAGTTCTGAGGATTGTCAGAGCC|TGACGCGCACTGTCTGT----
----SEQUENCER02:111:B815YKABXX:5:2208:4834:64362
-----GGGAGAGAGTTCTGAGGATTGTCAGAGCC|TGACGCGCACTGTCTGTGCC----
-----SEQUENCER02:111:B815YKABXX:5:1102:3494:39195
-----GGGAGAGAGTTCTGAGGATTGTCAGAGCC|TGACGCGCACTGTCTGTGCC----
-----SEQUENCER02:111:B815YKABXX:5:1103:15726:64409
-----GGGAGAGAGTTCTGAGGATTGTCAGAGCC|TGACGCGCACTGTCTGTGCC----
-----SEQUENCER02:111:B815YKABXX:5:1106:21268:35717
-----GGGAGAGAGTTCTGAGGATTGTCAGAGCC|TGACGCGCACTGTCTGTGCC----
-----SEQUENCER02:111:B815YKABXX:5:1108:11066:132001
-----GGGAGAGAGTGTTCTGAGGATTGTTAGAGCC|TGACGCGCACTGTCTGTGCC----
-----SEQUENCER02:111:B815YKABXX:5:1201:13261:98462
-----GGGAGAGAGTTCTGAGGATTGTCAGAGCC|TGACGCGCACTGTCTGTGCC----
-----SEQUENCER02:111:B815YKABXX:5:2103:8647:161702
-----GGGAGAGAGTTCTGAGGATTGTCAGAGCC|TGACGCGCACTGTCTGTGCC----
-----SEQUENCER02:111:B815YKABXX:5:2104:6147:62095
-----GGGAGAGAGTTCTGAGGATTGTCAGAGCC|TGACGCGCACTGTCTGTGCC----
-----SEQUENCER02:111:B815YKABXX:5:2106:10360:91935
-----GGGAGAGAGTTCTGAGGATTGTTAGAGCC|TGACGCGCACTGTCTGTGCC----
-----SEQUENCER02:111:B815YKABXX:5:2108:7893:31418
```

```
--------GCTGGGGAGAGAGTTCTGAGGATTGTCAGAGCC|GTGAGTCTCAGGGAGGC------
--------SEQUENCER02:111:B815YKABXX:5:1208:2045:157517
--------GCTGGGGAGAGAGTTCTGAGGATTGTCAGAGCC|GTGAGTCTCAGGGAGGC------
--------SEQUENCER02:111:B815YKABXX:5:2107:7208:43527
--------GCTGGGGAGAGAGTTCTGAGGATTGTCAGAGCC|GTGAGTCTCAGGGAGGC------
--------SEQUENCER02:111:B815YKABXX:5:2108:13006:49021
--------GCTGGGGAGAGAGTTCTGAGGATTGTCAGAGCC|GTGAGTCTCAGGGAGGC------
--------SEQUENCER02:111:B815YKABXX:5:2208:15048:142259
--------TGGGGAGAGAGTTCTGAGGATTGTCAGAGCC|GTGAGTCTCAGGGAGGCCT------
--------SEQUENCER02:111:B815YKABXX:5:1104:18502:122391
--------TGGGGAGAGAGTTCTGAGGATTGTCAGAGCC|GTGAGTCTCAGGGAGGCCT------
--------SEQUENCER02:111:B815YKABXX:5:1107:9818:111311
---------GGGGAGAGAGTTCTGAGGATTGTCAGAGCC|GTGAGTCCCAGGGAGGCCTG-----
--------SEQUENCER02:111:B815YKABXX:5:1104:11364:41710
---------GGGGAGAGAGTTCTGAGGATTGTCAGAGCC|GTGAGTCTCAGGGAGGCC-------
--------SEQUENCER02:111:B815YKABXX:5:1104:3261:158746
---------GGGGAGAGAGTTCTGAGGATTGTCAGAGCC|GTGAGTCTCAGGGAGGCCTG-----
--------SEQUENCER02:111:B815YKABXX:5:1108:5156:185893
---------GGGGAGAGAGTTCTGAGGATTGTCAGAGCC|GTGAGTCTCAGGGAGGCCTG-----
--------SEQUENCER02:111:B815YKABXX:5:1204:15733:22618
---------GGGGAGAGAGTTCTGAGGATTGTCAGAGCC|GTGAGTCTCAGGGAGGCCTG-----
--------SEQUENCER02:111:B815YKABXX:5:1206:10318:77664
---------GGGGAGAGAGTTCTGAGGATTGTCAGAGCC|GTGAGTCTCAGGGAGGCCTG-----
--------SEQUENCER02:111:B815YKABXX:5:1208:4810:24337
---------GGGGAGAGAGTTCTGAGGATTGTCAGAGCC|GTGAGTCTCAGGGAGGCC-------
--------SEQUENCER02:111:B815YKABXX:5:2101:1805:180200
---------GGGGAGAGAGTTCTGAGGATTGTCAGAGCC|GTGAGTCTCAGGGAGGCCTG-----
--------SEQUENCER02:111:B815YKABXX:5:2104:20948:151492
---------GGGGAGAGAGTTCTGAGGATTGTCAGAGCC|GTGAGTCTCAGGGAGGCCTG-----
--------SEQUENCER02:111:B815YKABXX:5:2106:20874:118682
---------GGGGAGAGAGTTCTGAGGATTGTCAGAGCC|GTGAGTCTCAGGGAGGCCTG-----
--------SEQUENCER02:111:B815YKABXX:5:2201:18842:120452
```

FIGURE 3.44E

```
------------------------------------------GGGGAGAGAGTTCTGAGGATTGTCAGAGCC|GTGAGTCTCAGGGAGGCCTG-----------------------------
                                          SEQUENCER02:111:B815YKABXX:5:2204:1156:146043
                                          -GGGGAGAGAGTTCTGAGGATTGTTAGAGCC|GTGAGTCTCAGGGAGGCCTG----------------------------
                                          SEQUENCER02:111:B815YKABXX:5:2206:13384:34441
############################################################################################################################
--------
111GCCAAT_5   +chr17:37866134_-chr17:37949186     ERBB2_IKZF3
              acceptor_genomic_template
***********************************************************************************************************************
ATAGCTTCAAGTATAGTCGTTGTTCATTTCTTGCATTTTCTTCCCTGCAG|ATGATTCAATGAAAGTGAAAGATGAATACAGTGAAAGA
GATGAGAATGTT   junction_-chr17_37949186_NM_012481
                                                   SEQUENCER02:111:B815YKABXX:5:1105:3904:94837
TCTTCCCTGCAG|ATGATTAATGAAAGTGAAAGATGAATACAGTGAAAGA-------------------
                                                   SEQUENCER02:111:B815YKABXX:5:1205:3009:98623
TCTTCCCTGCAG|ATGATTAATGAAAGTGAAAGATGAATACAGTGAAAGA-------------------
#############################################################################################################################
#########
```

FIGURE 3.44F

3.45 ERBB2_IKZF3

```
111GCCAAT_5   +chr17:37868300_-chr17:37949186     ERBB2_IKZF3    fusion_template
***********************************************************************************************************************
AGAGGATGGAACACAGCGGTGTGAGAAGTGCAGCAAGCCCTGTGCCCGAG|ATGATTCAATGAAAGTGAAAGATGAATACAGTGAAAGA
GATGAGAATGTT   junction_+chr17_37868300_-chr17_37949186_NM_004448_NM_012481
              -------GCAGCAAGCCCTGTGCCCGAG|ATGATTCAATGAAAGTGAAAGATGAATGAATA---------
                                                   SEQUENCER02:111:B815YKABXX:5:1101:12657:139209
              -------GCAGCAAGCCCTGTGCCCGAG|ATGATTCAATGAAAGTGAAAGATGAATA---------
                                                   SEQUENCER02:111:B815YKABXX:5:1202:6172:26598
```

FIGURE 3.45A

```
                                            -------GCAGCAAGCCCTGTGCCCGAG|ATGATTCAATGAAAGTGAAAGATGAATA-----------
                                            SEQUENCER02:111:B815YKABXX:5:2107:1992:21279
                                            -------GCAGCAAGCCCTGTGCCCGAG|ATGATTCAATGAAAGTGAAAGATGAATA-----------
                                            SEQUENCER02:111:B815YKABXX:5:2108:11605:59164
                                            -------GCAGCAAGCCCTGTGCCCGAG|ATGATTCAATGAAAGTGAAAGATGAATA-----------
                                            SEQUENCER02:111:B815YKABXX:5:2201:16699:114782
                                            -------GCAGCAAGCCCTGTGCCCGAG|ATGATTCAATGAAAGTGAAAGATGAATA-----------
                                            SEQUENCER02:111:B815YKABXX:5:2205:6753:38798
########################################################################################################
111GCCAAT_5    +chr17:37868300_-chr17:37949186    ERBB2_IKZF3    donor_template
***************************************************************************************
AGAGGATGGAACACAGCGGTGTGAGAAGTGCAGCAAGCCCTGTGCCCGAG|TGTGCTATGGTCTCTGGGCATGGAGCACTTGCCGAGAGGTG
AGGGCAGTTACC   junction_+chr17_37868300_+chr17_37868575_NM_004448
                                                  --AAGCCCTGTGCCCGAG|TGTGCTATGGTCTGGGCATGGAGCACTTGCCGAGA----
                                            SEQUENCER02:111:B815YKABXX:5:2107:11253:117350

GTGCCCGAG|TGTGCTATGGTCTCTGGGCATGGAGCACTTGCCGAGAGGTGAGG----------------
SEQUENCER02:111:B815YKABXX:5:1108:8535:56515

GTGCCCGAG|TGTGCTATGGTCTCTGGGCATGGAGCACTTGCCGAGAGGTGAGG----------------
SEQUENCER02:111:B815YKABXX:5:1204:5199:148717

GTGCCCGAG|TGTGCTATGGTCTCTGGGCATGGAGCACTTGCCGAGAGGTGAGG----------------
SEQUENCER02:111:B815YKABXX:5:1206:12005:76336

GTGCCCGAG|TGTGCTATGGTCTCTGGGCATGGAGCACTTGCCGAGAGGTGAGG----------------
SEQUENCER02:111:B815YKABXX:5:1207:3262:173557

GTGCCCGAG|TGTGCTATGGTCTCTGGGCATGGAGCACTTGCCGAGAGGTGAGG----------------
SEQUENCER02:111:B815YKABXX:5:2101:12843:19121
```

FIGURE 3.45B

```
GTGCCCGAG|TGTGCTATGGTCTGGGCATGGAGCACTTGCCGAGAGGTGAGG-------
         SEQUENCER02:111:B815YKABXX:5:2102:19164:146394

GTGCCCGAG|TGTGCTATGGTCTGGGCATGGAGCACTTGCCGAGAGGTGAGG-------
         SEQUENCER02:111:B815YKABXX:5:2105:15971:140919

GTGCCCGAG|TGTGCTATGGTCTGGGCATGGAGCACTTGCCGAGAGGTGAGG-------
         SEQUENCER02:111:B815YKABXX:5:2204:14590:68638

GTGCCCGAG|TGTGCTATGGTCTGGGCATGGAGCACTTGCCGAGAGGTGAGG-------
         SEQUENCER02:111:B815YKABXX:5:2207:2762:145438

GTGCCCGAG|TGTGCTATGGTCTGGGCATGGAGCACTTGCCGAGAGGTGAGG-------
         SEQUENCER02:111:B815YKABXX:5:2207:9884:81098

GCCCGAG|TGTGCTATGGTCTGGGTTTGGGCATGGAGCACTTGCCGAGAGGTGAGGGC----
        SEQUENCER02:111:B815YKABXX:5:1107:12173:21518

GCCCGAG|TGTGCTATGGTCTGGGTTTGGGCATGGAGCACTTGCCGAGAGGTGAGGGC----
        SEQUENCER02:111:B815YKABXX:5:1203:13688:175298

GCCCGAG|TGTGCTATGGTCTGGGCATGGAGCACTTGCCGAGAGGTGAGGGC----
        SEQUENCER02:111:B815YKABXX:5:1208:17825:75341

GCCCGAG|TGTGCTATGGTCTGGGCATGGAGCACTTGCCGAGAGGTGAGGGC----
        SEQUENCER02:111:B815YKABXX:5:2104:8843:86704

GCCCGAG|TGTGCTATGGTCTGGGCATGGAGCACTTGCCGAGAGGTGAGGGC----
        SEQUENCER02:111:B815YKABXX:5:2108:8883:119141

GCCCGAG|TGTGCTATGGTCTGGGCATGGAGCACTTGCCGAGAGGTGAGGGC----
        SEQUENCER02:111:B815YKABXX:5:2205:14331:195171
```

```
3.46 ERBB2_IKZF3
111GCCAAT_5_+chr17:37868701_-chr17:37949186           ERBB2_IKZF3_fusion_template
*******************************************************************************
TGCAAGAAGATCTTTGGGAGCCTGGCATTTCTGCCGGAGAGCTTTGATGG|ATGATTCAATGAAAGATGAATACAGTGAAAGA
GATGAGAATGTT   junction_+chr17_37868701_-chr17_37949186_NM_004448_NM_012481
-----------------------------TTGGGAGCCTGGCATTTCTGCCGGAGAGCTTTGATGG|ATGATTCAATGAA----
-------------SEQUENCER02:111:B815YKABXX:5:1103:17720:37661
-------------SEQUENCER02:111:B815YKABXX:5:1107:6831:125050
-------------SEQUENCER02:111:B815YKABXX:5:1108:9428:20410
-------------SEQUENCER02:111:B815YKABXX:5:1202:15989:123552
-------------SEQUENCER02:111:B815YKABXX:5:1204:1203:4922
-------------SEQUENCER02:111:B815YKABXX:5:1204:3599:98411
-------------SEQUENCER02:111:B815YKABXX:5:2102:4744:143973
-----------------------------TTGGGAGCCTGGCATTTCTGCCGGAGAGCTTTGATGG|ATGATTCAATGAA----
-----------------------------TTGGGAGCCTGGCATTTCTGCCGGAGAGCTTTGATGG|ATGATTCAATGAA----
-------------SEQUENCER02:111:B815YKABXX:5:2103:20518:198963
-------------SEQUENCER02:111:B815YKABXX:5:2108:20552:165121
-------------SEQUENCER02:111:B815YKABXX:5:2203:10327:130216
-----------------------------TTGGGAGCCTGGCATTTCTGCCGGAGAGCTTTGATGG|ATGATTCAATGAA----
-----------------------------TTGGGAGCCTGGCATTTCTGCCGGAGAGCTTTGATGG|ATGATTCAATGAA----
-------------SEQUENCER02:111:B815YKABXX:5:2205:20759:121455
-------------SEQUENCER02:111:B815YKABXX:5:2205:7087:124445
```

FIGURE 3.46A

```
----TTGGGAGCCTGGCATTTCTGCCGGAGAGCTTTGATGG|ATGATTCAATGAA------
    SEQUENCER02:111:B815YKABXX:5:2208:10990:152841
----TTGGGAGCCTGGCATTTCTGCCGGAGAGCTTTGATGG|ATGATTCAATGAA------
    SEQUENCER02:111:B815YKABXX:5:2208:11148:109397
----TGGGAGCCTGGCATTTCTGCCGGAGAGCTTTGATGG|ATGATTCAATGAAA-----
    SEQUENCER02:111:B815YKABXX:5:1102:10296:197918
----TGGGAGCCTGGCATTTCTGCCGGAGAGCTTTGATGG|ATGATTCAATGAAA-----
    SEQUENCER02:111:B815YKABXX:5:1103:13262:83856
----TGGGAGCCTGGCATTTCTGCCGGAGAGCTTTGATGG|ATGATTCAATGAAA-----
    SEQUENCER02:111:B815YKABXX:5:1103:19517:171841
----TGGGAGCCTGGCATTTCTGCCGGAGAGCTTTGATGG|ATGATTCAATGA-------
    SEQUENCER02:111:B815YKABXX:5:1103:20769:33966
----TGGGAGCCTGGCATTTCTGCCGGAGAGTTTGATGG|ATGATTCAATGAAA------
    SEQUENCER02:111:B815YKABXX:5:1103:20851:61136
----TGGGAGCCTGGCATTTCTGCCGGAGAGCTTTGATGG|ATGATTCAATGAAA-----
    SEQUENCER02:111:B815YKABXX:5:1104:16978:29196
----TGGGAGCCTGGCATTTCTGCCGGAGAGTTTTGATGG|ATGATTCAATGAAA-----
    SEQUENCER02:111:B815YKABXX:5:1106:5980:67141
----TGGGAGCCTGGCATTTCTGCCGGAGAGCTTTGATGG|ATGATTCAATGAAA-----
    SEQUENCER02:111:B815YKABXX:5:1201:2841:106550
----TGGGAGCCTGGCATTTCTGCCGGAGAGCTTTGATGG|ATGATTCAATGAAA-----
    SEQUENCER02:111:B815YKABXX:5:1201:4616:94614
----TGGGAGCCTGGCATTTCTGCCGGAGAGCTTTGATGG|ATGATTCAATGAAA-----
    SEQUENCER02:111:B815YKABXX:5:1203:1809:62799
----TGGGAGCCTGGCATTTCTGCCGGAGAGCTTTGATGG|ATGATTCAATGAAA-----
    SEQUENCER02:111:B815YKABXX:5:1203:5554:96606
----TGGGAGCCTGGCATTTCTGCCGGAGAGCTTTGATGG|ATGATTCAATGAAA-----
    SEQUENCER02:111:B815YKABXX:5:1204:3438:36081
----TGGGAGCCTGGCATTTCTGCCGGAGAGCTTTGATGG|ATGATTCAATGAAA-----
    SEQUENCER02:111:B815YKABXX:5:2104:7312:191592
----TGGGAGCCTGGCATTTCTGCCGGAGAGCTTTGATGG|ATGATTCAATGAAA-----
    SEQUENCER02:111:B815YKABXX:5:2106:14422:148442
```

FIGURE 3.46B

```
                   -TGGGAGCCTGGCATTTCTGCCGGAGAGCTTTGATGG|ATGATTCAATGAAA---------------------------------
                    SEQUENCER02:111:B815YKABXX:5:2107:4774:146126
                   -TGGGAGCCTGGCATTTCTGCCGGAGAGCTTTGATGG|ATGATTCAATGAAA---------------------------------
                    SEQUENCER02:111:B815YKABXX:5:2202:1196:133756
                   -TGGGAGCCTGGCATTTCTGCCGGAGAGTTTGATGG|ATGATTCAATGAAA----------------------------------
                    SEQUENCER02:111:B815YKABXX:5:2202:6168:16541
                   -TGGGAGCCTGGCATTTCTGCCGGAGAGCTTTGATGG|ATGATTCAATGAAA---------------------------------
                    SEQUENCER02:111:B815YKABXX:5:2205:9634:126224
                   -TGGGAGCCTGGCATTTCTGCCGGAGAGTTTTGATGG|ATGATTCAATGAAA---------------------------------
                    SEQUENCER02:111:B815YKABXX:5:2206:13955:39035
                   -TGGGAGCCTGGCATTTCTGCCGGAGAGCTTTGATGG|ATGATTCAATGAAA---------------------------------
                    SEQUENCER02:111:B815YKABXX:5:2206:6879:5011
                   -TGGGAGCCTGGCATTTCTGCCGGAGAGCTTTGATGG|ATGATTCAATGAAA---------------------------------
                    SEQUENCER02:111:B815YKABXX:5:2208:12082:121534
                   -GGGAGCCTGGCATTTCTGCCGGAGAGCTTTGATGG|ATGATTCAATGAAAG---------------------------------
                    SEQUENCER02:111:B815YKABXX:5:1104:20429:169972
                   -GGGAGCCTGGCATTTCTGCCGGAGAGCTTTGATGG|ATGATTCAATGAAAG---------------------------------
                    SEQUENCER02:111:B815YKABXX:5:2103:16795:176240
                   --GCCGGAGAGCTTTGATGG|ATGATTCAATGAAAGTGAAAGATGAATACAGT-------
                    SEQUENCER02:111:B815YKABXX:5:1101:17283:81502
                   --GCCGGAGAGCTTTGATGG|ATGATTCAATGAAAGTGAAAGATGAATACAGT-------
                    SEQUENCER02:111:B815YKABXX:5:1105:3743:9061
                   --GCCGGAGAGCTTTGATGG|ATGATTCAATGAAAGTGAAAGGGAAAGTGAATACAGT---
                    SEQUENCER02:111:B815YKABXX:5:1108:10915:8369
                   --GCCGGAGAGCTTTGATGG|ATGATTCAATGAAAGTGAAAGTGAAAGATGAATACAGT--
                    SEQUENCER02:111:B815YKABXX:5:1108:7660:191215
                   --GCCGGAGAGCTTTGATGG|ATGATTCAATGAAAGTGAAAGTGAAAGATGAATACAGT--
                    SEQUENCER02:111:B815YKABXX:5:1201:2111:114889
                   --GCCGGAGAGCTCTGATGG|ATGATTCAATGAAAGTGAAAGTGAAAGATGAATACAGT--
                    SEQUENCER02:111:B815YKABXX:5:1202:3943:48606
                   --GCCGGAGAGCTTTGATGG|ATGATTCAATGAAAGTGAAAGTGAAAGATGAATACAGT--
                    SEQUENCER02:111:B815YKABXX:5:1202:4963:122834
```

FIGURE 3.46C

```
----------SEQUENCER02:111:B815YKABXX:5:1204:7358:6873    ----GCCGGAGAGCTTTGATGG|ATGATTCAATGAAAGTGAAAGATGAATACAGT----
----------SEQUENCER02:111:B815YKABXX:5:1205:13308:188874 ----GCCGGAGAGCTTTGATGG|ATGATTCAATGAAAGTGAAAGATGAATACAG-----
----------SEQUENCER02:111:B815YKABXX:5:1205:19225:104448 ----GCCGGAGAGCTTTGATGG|ATGATTCAATGAAAGTGAAAGATGAATACAGT----
----------SEQUENCER02:111:B815YKABXX:5:1207:15120:148755 ----GCCGGAGAGCTTTGATGG|ATGATTCAATGAAAGTGAAAGATGAATACAGT----
----------SEQUENCER02:111:B815YKABXX:5:2101:10855:112596 ----GCCGGAGAGCTTTGATGG|ATGATTCAATGAAAGTGAAAGATGAATACAGT----
----------SEQUENCER02:111:B815YKABXX:5:2101:8153:172488  ----GCCGGAGAGCTTTGATGG|ATGATTCAATGAAAGTGAAAGATGAATACAGT----
----------SEQUENCER02:111:B815YKABXX:5:2102:19093:38648  ----GCCGGAGAGCTTTGATGG|ATGATTCAATGAAAGTGAAAGATGAATACAGT----
----------SEQUENCER02:111:B815YKABXX:5:2104:9941:115627  ----GCCGGAGAGCTTTGATGG|ATGATTCAATGAAAGTGAAAGATGAATACAGT----
----------SEQUENCER02:111:B815YKABXX:5:2105:13611:69225  ----GCCGGAGAGCTTTGATGG|ATGATTCAATGAAAGTGAAAGATGAATACAGT----
----------SEQUENCER02:111:B815YKABXX:5:2106:14174:190370 ----GCCGGAGAGCTTTGATGG|ATGATTCAATGAAAGTGAAAGATGAATACAGT----
----------SEQUENCER02:111:B815YKABXX:5:2106:5841:43142   ----GCCGGAGAGCTTTGATGG|ATGATTCAATGAAAGTGAAAGATGAATACAGT----
----------SEQUENCER02:111:B815YKABXX:5:2106:7633:141676  ----GCCGGAGAGCTTTGATGG|ATGATTCAATGAAAGTGAAAGATGAATACAGT----
----------SEQUENCER02:111:B815YKABXX:5:2107:13981:46027  ----GCCGGAGAGCTTTGATGG|ATGATTCAATGAAAGTGAAAGATGAATACAGT----
----------SEQUENCER02:111:B815YKABXX:5:2108:15496:50189  ----GCCGGAGAGCTTTGATGG|ATGATTCAATGAAAGTGAAAGATGAATAC-------
----------SEQUENCER02:111:B815YKABXX:5:2108:5579:81064   ----GCCGGAGAGCTTTGATGG|ATGATTCAATGAAAGTGAAAGATGAATACAGT----
----------SEQUENCER02:111:B815YKABXX:5:2202:5669:14750   ----GCCGGAGAGCTTTGATGG|ATGATTCAATGAAAGTGAAAGATGAATACAGT----
```

FIGURE 3.46D

```
-------------------------------------GCCGGAGAGCTTTGATGG|ATGATTCAATGAAAGTGAAAGATGAATACAGT-----
                      SEQUENCER02:111:B815YKABXX:5:2204:12341:126110
-------------------------------------GCCGGAGAGCTTTGATGG|ATGATTCAATGAAAGTGAAAGATGAATACAGT-----
                      SEQUENCER02:111:B815YKABXX:5:2204:15359:28107
-------------------------------------GCCGGAGAGCTTTGATGG|ATGATTCAATGAAAGTGAAAGATGAATACAGT-----
                      SEQUENCER02:111:B815YKABXX:5:2204:3512:188225
-------------------------------------GCCGGAGAGCTTTGATGG|ATGATTCAATGAAAGTGAAAGATGAATACAGT-----
                      SEQUENCER02:111:B815YKABXX:5:2205:11513:38058
-------------------------------------GCCGGGGAGCTTTGATGG|ATGATTCAATGAAAGTGAAAGATGAATACAGT-----
                      SEQUENCER02:111:B815YKABXX:5:2206:13860:23300
-------------------------------------GCCGGAGAGCTTTGATGG|ATGATTCAATGAAAGTGAAAGATGAATACAGT-----
                      SEQUENCER02:111:B815YKABXX:5:2206:18076:147146
-------------------------------------GCCGGAGAGCTTTGATGG|ATGATTCAATGAAAGTGAAAGATGAATACAG------
                      SEQUENCER02:111:B815YKABXX:5:2208:12816:98837
TTTGATGG|ATGATTCAATGAAAGTGAAAGATGAATACAGTGAAACAGATG---------
        SEQUENCER02:111:B815YKABXX:5:1108:14175:132501
TTTGATGG|ATGATTCAATGAAAGTGAAAGATGAATACAGTGAAACAGATG---------
        SEQUENCER02:111:B815YKABXX:5:1208:11270:55281
TTTGATGG|ATGATTCAATGAAAGTGAAAGATGAATACAGTGAAACAGATG---------
        SEQUENCER02:111:B815YKABXX:5:2106:9340:35575
TTTGATGG|ATGATTCAATGAAAGTGAAAGATGAATACAGTGAAACAGATG---------
        SEQUENCER02:111:B815YKABXX:5:2205:3945:51133
TTTGATGG|ATGATTCAATGAAAGTGAAAGATGAATACAGTGAAACAGATG---------
        SEQUENCER02:111:B815YKABXX:5:2206:17453:185056
TTTGATGA|ATGATTCAATGAAAGTGAAAGATGAATACAGTGAAAGAGATGA--------
        SEQUENCER02:111:B815YKABXX:5:1101:19971:116886
```

FIGURE 3.46E

```
TTGATGG|ATGATTCAATGAAAGTGAAAGATGAATACAGTGAAAGAGATGA------
        SEQUENCER02:111:B815YKABXX:5:1102:6380:185305
                                                      |
TTGATGG|ATGATTCAATGAAAGTGAAAGATGAATACAGTGAAAGAGATGA------
        SEQUENCER02:111:B815YKABXX:5:1106:2132:163391
                                                      |
TTGATGG|ATGATTCAATGAAAGTGAAAGATGAATACAGTGAAAGAGATGA------
        SEQUENCER02:111:B815YKABXX:5:1206:20856:181480
                                                      |
TTGATGG|ATGATTCAATGAAAGTGAAAGATGAATACAGTGAAAGAGATGA------
        SEQUENCER02:111:B815YKABXX:5:2205:6825:9644
##########################################################
111GCCAAT_5    +chr17:37868701_-chr17:37949186   ERBB2_IKZF3    donor_template
**********                                                ************************************************
TGCAAGAAGATCTTTGGGAGCCTGGCATTTCTGCCGGAGAGCTTTGATGG|GGACCCAGCCTCCAACACTGCCCGCTCCAGCCAGAGC
AGCTCCAAGTGT    junction  +chr17_37868701_-chr17_37871539_NM_004448
            ------GGCATTTCTGCCGGAGAGCTTTGATGG|GGACCCAGCCTCCAACACTGCCC-------
              SEQUENCER02:111:B815YKABXX:5:1104:9826:113238
            ------GGCATTTCTGCCGGAGAGCTTTGATGG|GGACCCAGCCTCCAACACTGCCC-------
              SEQUENCER02:111:B815YKABXX:5:1105:10475:174946
            ------GGCATTTCTGCCGGAGAGCTTTGATGG|GGACCCAGCCTCCAACACTGCCC-------
              SEQUENCER02:111:B815YKABXX:5:1108:17272:34596
            ------GGCATTTCTGCCGGAGAGCTTTGATGG|GGACCCAGCCTCCAATACTGCCC-------
              SEQUENCER02:111:B815YKABXX:5:1205:20414:48192
            ------GGCATTTCTGCCGGAGAGCTTTGATGG|GGACCCAGCCTCCAACACTGCCC-------
              SEQUENCER02:111:B815YKABXX:5:2206:11668:91215
            ------GGCATTTCTGCCGGAGAGCTTTGATGG|GGACCCAGCCTCCAACACTGCCC-------
              SEQUENCER02:111:B815YKABXX:5:2208:14667:121689
            ------GGCATTTCTGCCGGAGAGCTTTGATGG|GGACCCAGCCTCCAACACTGCCC-------
              SEQUENCER02:111:B815YKABXX:5:2208:9377:158371
```

FIGURE 3.46F

```
--------CTGCCGGAGAGCTTTGATGG|GGACCCAGCCTCCAACACTGCCCCGCTCCA--------  SEQUENCER02:111:B815YKABXX:5:1101:7451:71894
--------CTGCCGGAGAGCTTTGATGG|GGACCCAGCCTCCAACACTGCCCCGCTCCA--------  SEQUENCER02:111:B815YKABXX:5:2201:6441:63601
-------TGCCGGAGAGCTTTGATGG|GGACCCAGCCTCCAACACTGCCCCGCTCCAG--------  SEQUENCER02:111:B815YKABXX:5:1101:6150:49561
-------TGCCGGAGAGCTTTGATGG|GGACCCAGCCTCCAACACTGCCCCGCTCCAG--------  SEQUENCER02:111:B815YKABXX:5:1104:10864:59290
-------TGCCGGAGAGCTTTGATGG|GGACCCAGCCTCCAACACTGCCCCGCTCCAG--------  SEQUENCER02:111:B815YKABXX:5:1104:7741:11169
-------TGCCGGAGAGCTTTGATGG|GGACCCAGCCTCCAACACTGCCCCGCTCCAG--------  SEQUENCER02:111:B815YKABXX:5:1106:13171:61989
-------TGCCGGAGAGCTTTGATGG|GGACCCAGCCTCCAACACTGCCCCGCTCCAG--------  SEQUENCER02:111:B815YKABXX:5:1108:4417:152512
-------TGCCGGAGAGCTTTGATGG|GGACCCAGCCTCCAACACTGCCCCGCTCCAG--------  SEQUENCER02:111:B815YKABXX:5:1204:8620:34808
-------TGCCGGAGAGCTTTGATGG|GGACCCAGCCTCCAACACTGCCCCGCTCCAG--------  SEQUENCER02:111:B815YKABXX:5:1206:18501:164392
-------TGCCGGAGAGCTATGATGG|GGACCCAGCCTCCAACACTGCCCCGCTCCAG--------  SEQUENCER02:111:B815YKABXX:5:2102:15958:47735
-------TGCCGGAGAGCTTTGATGG|GGACCCAGCCTCCAACACTGCCCCGCTCCAG--------  SEQUENCER02:111:B815YKABXX:5:2106:19050:87536
-------TGCCGGAGAGCTTTGATGG|GGACCCAGCCTCCAACACTGCCCCGCTCCAG--------  SEQUENCER02:111:B815YKABXX:5:2107:2014:171771
-------TGCCGGAGAGCTTTGATGG|GGACCCAGCCTCCAACACTGCCCCGCTCCAG--------  SEQUENCER02:111:B815YKABXX:5:2107:20495:61096
-------TGCCGGAGAGCTTTGATGG|GGACCCAGCCTCCAACACTGCCCCGCTCCAG--------  SEQUENCER02:111:B815YKABXX:5:2204:13932:10714
-------TGCCGGAGAGCTTTGATGG|GGACCCAGCCTCCAACACTGCCCCGCTCCAG--------  SEQUENCER02:111:B815YKABXX:5:2205:10408:195308
-------TGCCGGAGAGCTTTGATGG|GGACCCAGCCTCCAACACTGCCCCGCTCCAG--------  SEQUENCER02:111:B815YKABXX:5:2205:1302:95041
```

FIGURE 3.46G

```
----------TGCCGGAGAGCTTTGATGG|GGACCCAGCCTCCAACACTGCCCCGCTCCAG-----  SEQUENCER02:111:B815YKABXX:5:2206:20966:20543
---------GCCGGAGAGCTTTGATGG|GGACCCAGCCTCCAACACTGCCCCGCTCCAGC----  SEQUENCER02:111:B815YKABXX:5:1103:11138:124291
---------GCCGGAGAGCTTTGATGG|GGACCCAGCCTTCAACACTGCCCCGCTCCAGC----  SEQUENCER02:111:B815YKABXX:5:1104:7208:88899
---------GCCGGAGAGCTTTGATGG|GGACCCAGCCTCCAACACTGCCCCGCTCCAGC----  SEQUENCER02:111:B815YKABXX:5:1105:11318:109656
---------GCCGGAGAGCTTTGATGG|GGACCCAGCCTCCAACACTGCCCCGCTCCAGC----  SEQUENCER02:111:B815YKABXX:5:1105:13661:97717
---------GCCGGAGAGCTTTGATGG|GGACCCAGCCTCCAACACTGCCCCGCTCCAGC----  SEQUENCER02:111:B815YKABXX:5:1201:10404:21906
---------GCCGGAGAGCTTTGATGG|GGACCCAGCCTCCAACACTGCCCCGCTCCAGC----  SEQUENCER02:111:B815YKABXX:5:1201:9038:143727
---------GCCGGAGAGCTTTGATGG|GGACCCAGCCTCCAACACTGCCCCGCTCCAGC----  SEQUENCER02:111:B815YKABXX:5:1204:17428:72820
---------GCCGGAGAGCTTTGATGG|GGACCCAGCCTCCAACACTGCCCCGCTCCAGC----  SEQUENCER02:111:B815YKABXX:5:1204:3977:113331
---------GCCGGAGAGCTTTGATGG|GGACCCAGCCTCCAACACTGCCCCGCTCCAGC----  SEQUENCER02:111:B815YKABXX:5:2103:3823:105650
---------GCCGGAGAGCTTTGATGG|GGACCCAGCCTCCAACACTGCCCCGCTCCAGC----  SEQUENCER02:111:B815YKABXX:5:2106:14432:85624
---------GCCGGAGAGCTTTGATGG|GGACCCAGCCTCCAACACTGCCCCGCTCCAGC----  SEQUENCER02:111:B815YKABXX:5:2202:14906:39505
---------GCCGGAGAGCTTTGATGG|GGACCCAGCCTCCAACACTGCCCCGCTCCAGC----  SEQUENCER02:111:B815YKABXX:5:2203:6762:76012
---------GCCGGAGAGCTTTGATGG|GGACCCAGCCTCCAACACTGCCCCGCTCCAGC----  SEQUENCER02:111:B815YKABXX:5:2205:20752:43456
---------GCCGGAGAGCTTTGATGG|GGACCCAGCCTCCAACACTGCCCCGCTCCAGC----  SEQUENCER02:111:B815YKABXX:5:2206:18950:26588
---------GCCGGAGAGCTTTGATGG|GGACCCAGCCTCCAACACTGCCCCGCTCCAGC----  SEQUENCER02:111:B815YKABXX:5:2206:5595:73161
```

```
3.47 TFG_GPR128
111GCCAAT_6      +chr3:100438902_+chr3:100348442       TFG_GPR128      fusion_template
*****************************************************************************************
CCTTTCCTTTGCAATTCAGTGCAGTAGGATACTGAAACTGACATTATTTG|GAAAATCTACTTCCTCATCAAGCACCCCTACAGAGTTC
TGCAGGAATGGT    junction_+chr3_100438902_+chr3_100348442_NM_006070_NM_032787
----------GCAATTCAGTGCAGTAGGATACTGAAACTGACATTATTTG|GAAAATCTAC-----------------------
                SEQUENCER02:111:B815YKABXX:6:1207:4128:54983
----------GCAATTCAGTGCAGTAGGATACTGAAACTGACATTATTTG|GAAAATCTAC-----------------------
                SEQUENCER02:111:B815YKABXX:6:2202:4093:108949
----------GCAATTCAGTGCAGTAGGATACTGAAACTGACATTATTTG|GAAAATCTAC-----------------------
                SEQUENCER02:111:B815YKABXX:6:2204:4878:58826
#######################################################################################
111GCCAAT_6      +chr3:100438902_+chr3:100348442       TFG_GPR128      donor_template
*****************************************************************************************
CCTTTCCTTTGCAATTCAGTGCAGTAGGATACTGAAACTGACATTATTTG|TTAAATGGCCAGCCAAGACCCCTTGAATCAAGTCAGGTG
AAATATCTCCGT    junction_+chr3_100438902_+chr3_100447556_NM_006070
#######################################################################################
111GCCAAT_6      +chr3:100438902_+chr3:100348442       TFG_GPR128      acceptor_template
*****************************************************************************************
CATCATTTTGGGACTGGGCATCTGGAGGATTGTGATCAGATCCAAAGAG|GAAAATCTACTTCCTCATCAAGCACCCCTACAGAGTTC
TGCAGGAATGGT    junction_+chr3_100328815_+chr3_100348442_NM_032787
#######################################################################################
111GCCAAT_6      +chr3:100438902_+chr3:100348442       TFG_GPR128      donor_genomic_template
*****************************************************************************************
CCTTTCCTTTGCAATTCAGTGCAGTAGGATACTGAAACTGACATTATTTG|GTGAGTAGTAAACTTTCTAATGAATTTACTATTTTATT
CATTGTATTTTA    junction_+chr3_100438902_NM_006070
```

FIGURE 3.47A

#########################################################################
#####
111 GCCAAT_6      +chr3:100438902_+chr3:100348442     TFG_GPR128
               acceptor_genomic_template
***********************************************************************************
*********
GAAATGAATCAGCCAGTTCATGACTATTCTGTGTTATTTATTGTTTCTTTAG|GAAAAATCTACTTCCTCATCAAGCACCCCTACAGAGTTC
TGCAGGAATGGT  junction_+chr3_100348442_NM_032787
#########################################################################
###

FIGURE 3.47B

3.48 GREB1_MBOAT2
111 TTAGGC_2   +chr2:11680234_-chr2:9098771   GREB1_MBOAT2   fusion_template
**********************************************************************************
**********
TCTTGGCTGGTTGGTCTGTGAGTGCCTGAAGTGACCAGCTTTTTGTAAG|GTCAACTTTGTAGTGCCAACTCTTTGCCTTGCTAGC
AGCCATTGGTT   junction_+chr2_11680234_-chr2_9098771_NM_148903_NM_138799
-----------  SEQUENCER02:111:B815YKABXX:2:1107:17418:52800
----------GTGGAGTGCCTGAAGTGACCAGCTTTTTGTAAG|GTCAACTTTGTAGTGTG----------
#########################################################################
###
111 TTAGGC_2   +chr2:11680234_-chr2:9098771   GREB1_MBOAT2   donor_template
**********************************************************************************
**********
TCTTGGCTGGTTGGTCTGTGAGTGCCTGAAGTGACCAGCTTTTTGTAAG|TAGCTGCAGCTGAGGACAGCCACCTTTCTTCGTCTCT
GCTGAGCGAAGG  junction_+chr2_11680234_+chr2_11696580_NM_148903
#########################################################################
###
111 TTAGGC_2   +chr2:11680234_-chr2:9098771   GREB1_MBOAT2   acceptor_template
**********************************************************************************
**********

FIGURE 3.48A

```
CCACCCCTGCTGCAGCCCCTCAGCAACGCCGTGCAGCTGCCCATCGACCAG|GTCAACTTTGTAGTGTGCCAACTCTTTGCCTTGCTAGC
AGCCATTTGGTT    junction_-chr2_9143669_-chr2_9098771_NM_138799
------------------CGCCGTGCAGCTGCCCATCGACCAG|GTCAACTTTGTAGTGTGCCAACTCT------
                SEQUENCER02:111:B815YKABXX:2:2105:7572:187995
---------------------GCAGCTGCCCATCGACCAG|GTCAACTTTGTAGTGTGCCAACTCTTTGCCT------
                SEQUENCER02:111:B815YKABXX:2:1202:15739:22287
---------------------GCAGCTGCCCATCGACCAG|GTCAACTTTGTAGTGTGCCAACTCTTTGCCT------
                SEQUENCER02:111:B815YKABXX:2:2104:7553:150953
-----------------------GCCCATCGACCAG|GTCAACTTTGTAGTGTGCCAACTCTTTGCCTTGCTAG-
                SEQUENCER02:111:B815YKABXX:2:1206:7004:250067
-----------------------GCCCATCGACCAG|GTCAACTTTGTAGTGTGCCAACTCTTTGCCTTGCTAG-
                SEQUENCER02:111:B815YKABXX:2:2105:1796:2886
############################################################################
111TTAGGC_2    +chr2:11680234_-chr2:9098771  GREB1_MBOAT2  donor_genomic_template
**********************************************************************
TCTTGGCTGGTTGGTCTGTGGAGTGCCTGAAGTGACCAGCTTTTTGTAAG|GTACGGTTTATTTGACTTTGCAAGCGAGCACCTGCTTT
GGGGGTTGGAGA    junction_+chr2_11680234_NM_148903
############################################################################
111TTAGGC_2    +chr2:11680234_-chr2:9098771  GREB1_MBOAT2  acceptor_genomic_template
**********************************************************************
AAAAATTCAGGTCTGTGTTGCTAATACAAAATTTAATTTTCTTTACAG|GTCAACTTTGTAGTGTGCCAACTCTTTGCCTTGCTAGC
AGCCATTTGGTT    junction_-chr2_9098771_NM_138799
############################################################################
```

FIGURE 3.48B

3.49 RREB1_DSP

```
111TTAGGC_2      +chr6:7108001_+chr6:7555951    RREB1_DSP_fusion_template
*************************************************************************
CGTCCCCAGGAGACTCGCAGGAGCAACACGTGATGTGTCTACTTATCAGG|TCAAACCGGCACGATGTCCAGCACCAGAACCAGAACA
CCATCCAGGAGC     junction_+chr6_7108001_+chr6_7555951_NM_001168344_NM_004415
----------------CGCAGGAGCAACACGTGATGTGTCTACTTATCAGG|TCAAACCGGCACGAT---------------------
                SEQUENCER02:111:B815YKABXX:2:1201:17367:96628
##########################################################################
111TTAGGC_2      +chr6:7108001_+chr6:7555951    RREB1_DSP_donor_template
*************************************************************************
CGTCCCCAGGAGACTCGCAGGAGCAACACGTGATGTGTCTACTTATCAGG|GTTGCTCCGACTGTGTGTTCCAGGAGTGGTGGCTCTGA
GGTGTGACCCTG     junction_+chr6_7108001_+chr6_7555951_NM_001168344
##########################################################################
111TTAGGC_2      +chr6:7108001_+chr6:7555951    RREB1_DSP_acceptor_template
*************************************************************************
TACTATTCTCGGCGCGGACTCGCAGGAGCAACACGTGATCACCGGACGAACTCGGACGGCTACTG|TCAAACCGGCACGATGTCCAGCACCAGAACCAGAACA
CCATCCAGGAGC     junction_+chr6_7542318_+chr6_7555951_NM_004415
##########################################################################
111TTAGGC_2      +chr6:7108001_+chr6:7555951    RREB1_DSP_donor_genomic_template
*************************************************************************
CGTCCCCAGGAGACTCGCAGGAGCAACACGTGATGTGTCTACTTATCAGG|GTGAGAGGGGAGAGCGAGACTCCGAGCGTGCGGGCGA
GGAAGCTGGGCG     junction_+chr6_7108001_NM_001168344
##########################################################################
111TTAGGC_2      +chr6:7108001_+chr6:7555951    RREB1_DSP_acceptor_genomic_template
*************************************************************************
```

FIGURE 3.49A

```
AATTGAAATAGGTTATTGATGTCTGGTTTCTCTGTGTTTGCCTCCTTAG|TCAAACCGGCACGATGTCCAGGCACCAGAACCAGAACA
CCATCCAGGAGC  junction +chr6_7555951_NM_004415
##############################################################################
##############
```

FIGURE 3.49B

3.50 ZBTB34_SCAI

```
111TTAGGC_3    +chr9:129623018 -chr9:127818286      ZBTB34_SCAI    fusion_template
***********************************************************************************
***********
GGCGGAGGGGCGCCGCGGGCGGGGCGGGCGATGTGAGCGCGGCGCTCTGACAG|GACTGAATTTGCTCTTAAAGAAATCATGTCCTCTGGAG
GTGCTGAAGATG  junction_+chr9_129623018_-chr9_127818286_NM_0010099270_NM_173690
***********************************************************-----------------------------
                                        CGGCGCTCTGGACAG|GACTGAATTTACTCTTAAAGAAATCATGTCCTCTG---
         SEQUENCER02:111:B815YKABXX:3:2107:6626:40736
                                        CGGCGCTCTGGACAG|GACTGAATTTACTCTTAAAGAAATCATGTCCTCTG---
         SEQUENCER02:111:B815YKABXX:3:2107:6673:7177
#####################################################################################
###########
111TTAGGC_3    +chr9:129623018 -chr9:127818286      ZBTB34_SCAI    donor_template
***********************************************************************************
***********
GGCGGAGGGGCGCCGCGGGCGGGGCGGGCGATGTGAGCGCGGCGCTCTGGACAG|AGTACGCTTCATGTCAGTAGAAATGGACAGCAGCAGTT
TTATTCAGTTTG  junction_+chr9_129641669_NM_0010099270
*****************************************************------------------------------
         ---GGCGGGCGATGTGAGCGCGGCGCTCTGGACAG|AGTACGCTTCATGTCAGT--------
         SEQUENCER02:111:B815YKABXX:3:2101:9745:103186
         ---GGCGGGCGATGTGAGCGCGGCGCTCTGGACAG|AGTACGCTTCATGTCAGT--------
         SEQUENCER02:111:B815YKABXX:3:2108:9683:187967
         ---GGCGGGCGATGTGAGCGCGGCGCTCTGGACAG|AGTACGCTTCATGTCAGT--------
         SEQUENCER02:111:B815YKABXX:3:2206:12124:124186
         ---GGCGGGCGATGTGAGCGCGGCGCTCTGGACAG|AGTACGCTTCATGTCAGT--------
         SEQUENCER02:111:B815YKABXX:3:2207:17405:161115
         ----CGGGCGATGTGAGCGCGGCGCTCTGGACAG|AGTACGCTTCATGTCAGTAG-------
         SEQUENCER02:111:B815YKABXX:3:1105:15173:94258
```

FIGURE 3.50A

```
------------------------------------CGGGCGATGTGAGCGGCGGCGCTCTGGACACAG|AGTACGCTTCATGTCAGTAG---------
                                    SEQUENCER02:111:B815YKABXX:3:1107:5540:60037
------------------------------------CGGGCGATGTGAGCGGCGGCGCTCTGGACACAG|AGTACGCTTCATGTCAGTAG---------
                                    SEQUENCER02:111:B815YKABXX:3:2105:16934:4871
------------------------------------CGGGCGATGTGAGCGGCGGCGCTCTGGACACAG|AGTACGCTTCATGTCAGTAG---------
                                    SEQUENCER02:111:B815YKABXX:3:2106:19720:128016
------------------------------------CGGGCGATGTGAGCGGCGGCGCTCTGGACACAG|AGTACGCTTCATGTCAGTAG---------
                                    SEQUENCER02:111:B815YKABXX:3:2206:6120:168274
GGACACAG|AGTACGCTTCATGTCAGTAGAAATGGACAGCAGCAGTTTTATTC---------
        SEQUENCER02:111:B815YKABXX:3:1102:3921:9762
GGACACAG|AGTACGCTTCATGTCAGTAGAAATGGACAGCAGCAGTTTTATTC---------
        SEQUENCER02:111:B815YKABXX:3:1202:12689:171864
GGACACAG|AGTACGCTTCATGTCAGTAGAAATGGACAGCAGCAGTTTTATTC---------
        SEQUENCER02:111:B815YKABXX:3:1202:17082:84208
GGACACAG|AGTACGCTTCATGTCAGTAGAAATGGACAGCAGCAGTTTTATTC---------
        SEQUENCER02:111:B815YKABXX:3:1205:5660:75377
GGACACAG|AGTACGCTTCATGTCAGTAGAAATGGACAGCAGCAGTTTTATTC---------
        SEQUENCER02:111:B815YKABXX:3:1208:1555:14272
GGACACAG|AGTACGCTTCATGTCAGTAGAAATGGACAGCAGCAGTTTTATTC---------
        SEQUENCER02:111:B815YKABXX:3:1208:7296:73337
GGACACAG|AGTACGCTTCATGTCAGTAGAAATGGACAGCAGCAGTTTTATTC---------
        SEQUENCER02:111:B815YKABXX:3:2104:17849:186297
GGACACAG|AGTACGCTTCATGTCAGTAGAAATGGACAGCAGCAGTTTTATTC---------
        SEQUENCER02:111:B815YKABXX:3:2108:19610:32407
```

```
3.51 LRP5_KAT6A
111TTAGGC_4    +chr11:68080273 -chr8:41907225     LRP5_KAT6A     fusion_template
***************************************************************************************
GCTGCTGCTGCTGCTGGCTGTGGGCTGCCCGGCCCCCGCCGCGG|GATTCTTTCTACTAATCCAGATACTTGTTGAAGTGCTG
ACTAGTTTCTTG    junction +chr11_68080273 -chr8_41907225 NM_002335_NM_001099412
------------GCTGCTGGCCGCTGTGGGCTGCCCGGCCCCCGCCGCGG|GATTCTTTC-----------------------
            SEQUENCER02:111:B815YKABXX:4:1201:13922:87407
------------GGCGCTGTGGGCTGCCCGGCCCCCGCCGCGG|GATTCTTTCTACTAATCC-------------------
            SEQUENCER02:111:B815YKABXX:4:1204:14780:97597
------------GGCGCTGTGGGCTGCCCGGCCCCCGCCGCGG|GATTCTTTCTACTAATCC-------------------
            SEQUENCER02:111:B815YKABXX:4:1206:11809:42099
------------GGCGCTGTGGGCTGCCCGGCCCCCGCCGCGG|GATTCTTTCTACTAATCC-------------------
            SEQUENCER02:111:B815YKABXX:4:1206:12809:118209
------------GGCGCTGTGGGCTGCCCGGCCCCCGCCGCGG|GATTCTTTCTACTAATCC-------------------
            SEQUENCER02:111:B815YKABXX:4:1208:13319:106486
------------GGCGCTGTGGGCTGCCCGGCCCCCGCCGCGG|GATTCTTTCTACTAAT---------------------
            SEQUENCER02:111:B815YKABXX:4:2201:3443:150452
------------GGCGCTGTGGGCTGCCCGGCCCCCGCCGCGG|GATTCTTTCTACTAATCC-------------------
            SEQUENCER02:111:B815YKABXX:4:2206:19095:36935
------------GGCGCTGTGGGCTGCCCGGCCCCCGCCGCGG|GATTCTTTCTACTAATCC-------------------
            SEQUENCER02:111:B815YKABXX:4:2206:20460:56400
----------------GTGCGGCTGCCCGGCCCCCGCCGCGG|GATTCTTTCTACTAATCCAGATAC--------------
            SEQUENCER02:111:B815YKABXX:4:1203:17184:126830
----------------GTGCGGCTGCCCGGCCCCCGCCGCGG|GATTCTTTCTACTAATCCAGATAC--------------
            SEQUENCER02:111:B815YKABXX:4:2105:16900:190508
--------------------GCTGCCCGGTCCCCGCCGCGG|GATTCTTTCTACTAATCCAGATACTTGTT---------
            SEQUENCER02:111:B815YKABXX:4:2203:5426:96554
--------------------GCTGCCCGGTCCCCGCCGCGG|GATTCTTTCTACTAATCCAGATACTTGTT---------
            SEQUENCER02:111:B815YKABXX:4:2206:16283:119801
------------------------GCCCGGCCCCCGCCGCGG|GATTCTTTCTACTAATCCAGATACTTGTTGAA------
            SEQUENCER02:111:B815YKABXX:4:1102:6987:157137
------------------------GCCCGGCCCCCGCCGCGG|GATTCTTTCTACTAATCCAGATACTTGTTGAA------
            SEQUENCER02:111:B815YKABXX:4:1102:7199:21337
```

FIGURE 3.51A

```
------------------------------------GCCCGGCCCCCGCCGCGG|GATTCTTTCTACTAATCCAGATACTTGTTGAA------
                    SEQUENCER02:111:B815YKABXX:4:1104:2638:62781
                                 ----GCCCGGCCCCCGCCGCGG|GATTCTTTCTACTAATCCAGATACTTGTTGAA------
                    SEQUENCER02:111:B815YKABXX:4:2206:20212:76010
CCCGCCGCGG|GATTCTTTCTACTAATCCAGATACTTGTTGAAGTGCTGAC---------
SEQUENCER02:111:B815YKABXX:4:2206:12932:104242
CGCCGCGG|GATTCTTTCTACTAATCCAGATACTTGTTGAAGTGCTGACTA--------
SEQUENCER02:111:B815YKABXX:4:1104:9272:45408
GCCGCGG|GATTCTTTCTACTAATCCAGATACTTGTTGAAGTGCTGACTAG--------
SEQUENCER02:111:B815YKABXX:4:1102:6933:109259
GCCGCGG|GATTCTTTCTACTAATCCAGATACTTGTTGAAGTGCTGACTAG--------
SEQUENCER02:111:B815YKABXX:4:1108:8712:198255
GCCGCGG|GATTCTTTCTACTAATCCAGATACTTGTTGAAGTGCTGACTAG--------
SEQUENCER02:111:B815YKABXX:4:1207:10202:107186
GCCGCGG|GATTCTTTCTACTAATCCAGATACTTGTTGAAGTGCTGACTAG--------
SEQUENCER02:111:B815YKABXX:4:2103:15697:40562
GCCGCGG|GATTCTTTCTACTAATCCAGATACTTGTTGAAGTGCTGACTAG--------
SEQUENCER02:111:B815YKABXX:4:2108:20651:165151
GCCGCGG|GATTCTTTCTACTAATCCAGATACTTGTTGAAGTGCTGACTAG--------
SEQUENCER02:111:B815YKABXX:4:2202:19139:48864
CCGCGG|GATTCTTTCTACTAATCCAGATACTTGTTGAAGTGCTGACTAGT--------
SEQUENCER02:111:B815YKABXX:4:1108:10613:78807
```

FIGURE 3.51B

```
-----------------------------------|CCGCGG|GATTCTTTCTACTAATCCAGATACTTGTTGAAGTGCTGACTAGT------
                              SEQUENCER02:111:B815YKABXX:4:1208:7822:35636
##########################################################################
##########
111TTAGGC_4    +chr11:68080273 -chr8:41907225       LRP5_KAT6A    donor_template
****************************************************************************************************
*******
GCTGCTGCTGCTGCTGCCGCTGTGCGGCTGCGCCGGGCCCCCGGCCCCCGGGG|CCTCGCCGTCCTGCTATTTGCCAACCGCCGGGACGTA
CGGCTGGTGGAC  junction_+chr11_68080273_+chr11_68115315_NM_002335
---------------------------------GCCGGACCCCGCGCGG|CCTCGCCGTCCTGCTATTTGCCAACCCCCGG------
             SEQUENCER02:111:B815YKABXX:4:1106:19792:19737
---------------------------------GCCGGACCCCGCGCGG|CCTCGCCGTCCTGCTATTTGCCAACCCCCGG------
             SEQUENCER02:111:B815YKABXX:4:2205:8061:77699
##########################################################################
##########
111TTAGGC_4    +chr11:68080273 -chr8:41907225       LRP5_KAT6A    acceptor_template
****************************************************************************************************
*******
TCTCCGCGGTCCGGCCCGGAGCCCCGGATCTCGGCTGTCCTTCCTCCCG|GATTCTTTCTACTAATCCAGATACTTGTTGAAGTGCTG
ACTAGTTTCTTG       junction_-chr8_41909419_-chr8_41907225_NM_001099412
-----------GGCCCCGGGGCCCCGGATCTCGGCTGTCCTTCCTCCCG|GATTCTTTCTAC---------
             SEQUENCER02:111:B815YKABXX:4:2102:15782:193752
-----------GGCCCCGGGGCCCCGGATCTCGGCTGTCCTTCCTCCCG|GATTCTTTCTAC---------
             SEQUENCER02:111:B815YKABXX:4:2103:3265:73639
-----------GGCCCCGGGGCCCCGGATCTCGGCTGTCCTTCCTCCCG|GATTCTTTCTAC---------
             SEQUENCER02:111:B815YKABXX:4:2205:15521:30221
-----------CCGGGGCCCCGGGGCCCCGGATCTCGGCTGTCCTTCCTCCCG|GATTCTTTCTACTAA-----
             SEQUENCER02:111:B815YKABXX:4:1207:19039:144980
-----------GGGGCCCCGGGGCCCCGGATCTCGGCTGTCCTTCCTCCCG|GATTCTTTCTACTAAT----
             SEQUENCER02:111:B815YKABXX:4:2201:7301:143765
-----------GGGGCCCCGGGGCCCCGGATCTCGGCTGTCCTTCCTCCCG|GATTCTTTCTACTAATC---
             SEQUENCER02:111:B815YKABXX:4:2202:18999:192358
```

FIGURE 3.51C

```
----------GGGGCCCCGGGATCTCGGCTGTCCTTCCTCCCG|GATTCTTTCTACTAATC---------
---------SEQUENCER02:111:B815YKABXX:4:2206:14481:156193
---------CGGCTGTCCTTCCTCCCG|GATTCTTTCTACTAATCCAGATACTTGTTGAA---
---------SEQUENCER02:111:B815YKABXX:4:1101:4595:194268
---------CGGCTGTCCTTCCTCCCG|GATTCTTTCTACTAATCCTGATACTTGTTGAA---
---------SEQUENCER02:111:B815YKABXX:4:1106:2883:70360
---------CGGCTGTCCTTCCTCCCG|GATTCTTTCTACTAATCTAGATACTTGTTGAA---
---------SEQUENCER02:111:B815YKABXX:4:1108:14899:169507
---------CGGCTGTCCTTCCTCCCG|GATTCTTTCTACTAATCCAGATACTTGTTGAA---
---------SEQUENCER02:111:B815YKABXX:4:1201:3048:30600
---------CGGCTGTCCTTCCTCCCG|GATTCTTTCTACTAATCCAGATACTTGTTGAA---
---------SEQUENCER02:111:B815YKABXX:4:1204:15053:66987
---------CGGCTGTCCTTCCTCCCG|GATTCTTTCTACTAATCCAGATACTTGTTGAA---
---------SEQUENCER02:111:B815YKABXX:4:1204:15442:157469
---------CGGCTGTCCTTCCTCCCG|GATTCTTTCTACTAATCCTGATACTTGTTGAA---
---------SEQUENCER02:111:B815YKABXX:4:1204:20468:169576
---------CGGCTGTCCTTCCTCCCG|GATTCTTTCTACTAATCCAGATACTTGTTGAA---
---------SEQUENCER02:111:B815YKABXX:4:1205:20612:53265
---------CGGCTGTCCTTCCTCCCG|GATTCTTTCTACTAATCCAGATACTTGTTGAA---
---------SEQUENCER02:111:B815YKABXX:4:2101:4011:82581
---------CGGCTGTCCTTCCTCCCG|GATTCTTTCTACTAATCCAGATACTTGTTGAA---
---------SEQUENCER02:111:B815YKABXX:4:2106:2278:159481
---------CGGCTGTCCTTCCTCCCG|GATTCTTTCTACTAATCCAGATACTTGTTGAA---
---------SEQUENCER02:111:B815YKABXX:4:2108:1927:150175
---------CGGCTGTCCTTCCTCCCG|GATTCTTTCTACTAATCCAGATACTTGTTGAA---
---------SEQUENCER02:111:B815YKABXX:4:2201:12159:78691
---------CGGCTGTCCTTCCTCCCG|GATTCTTTCTACTAATCCAGATACTTGTTGAA---
---------SEQUENCER02:111:B815YKABXX:4:2202:13333:82560
---------CGGCTGTCCTTCCTCCCG|GATTCTTTCTATTAATCCAGATACTTGTTGAA---
---------SEQUENCER02:111:B815YKABXX:4:2202:15281:14717
---------CGGCTGTCCTTCCTCCCG|GATTCTTTCTACTAATCCAGATACTTGTTGAA---
---------SEQUENCER02:111:B815YKABXX:4:2203:20819:139645
```

FIGURE 3.51D

```
                  SEQUENCER02:111 B815YKABXX:4:2205:13947:139579 ----CGGCTGTGTCCTTCCTCCCCG|GATTCTTTCTACTAATCCAGATACTTGTTGAA------
                  SEQUENCER02:111 B815YKABXX:4:2205:14336:48410  ----CGGCTGTGTCCTTCCTCCCCG|GATTCTTTCTACTAATCCAGATACTTGTTGAA------
                  SEQUENCER02:111 B815YKABXX:4:2205:6355:191829   ----CGGCTGTGTCCTTCCTCCCCG|GATTCTTTCTACTAATCCAGATACTTGTTGAA------
                  SEQUENCER02:111 B815YKABXX:4:2206:19270:103396  ----CGGCTGTGTCCTTCCTCCCCG|GATTCTTTCTACTAATCCAGATACTTGTTGAA------
                  SEQUENCER02:111 B815YKABXX:4:2207:1860:105799   ----CGGCTGTGTCCTTCCTCCCCG|GATTCTTTTCTACTAATCCAGATACTTGTTGAA------
########                                                  ##################################################################
111TTAGGC_4   +chr11:68080273_-chr8:41907225    LRP5_KAT6A    donor_genomic_template
*************                                                    ******************************************************************
                                                                 GCTGCTGCTGCTGCTGGGCTGTGCGGCTGCCCGGCCCCCGCCGCGG|GTAGGTGGGCGCAGGCCGGCCGGGGCCGCGGGGTTGCT
CGGACAATGGCC    junction_+chr11_68080273_NM_002335
########                                                  ##################################################################
111TTAGGC_4   +chr11:68080273_-chr8:41907225    LRP5_KAT6A
*************                                                    ******************************************************************
                  acceptor_genomic_template
AATGTCTAGAATTTGAAAGATGAAAGATTCACTTTTACTTTCATTGCAG|GATTCTTTCTACTAATCCAGATACTTGTTGAAGTGCTG
ACTAGTTTCTTG    junction_-chr8_41907225_NM_0011099412
########                                                  ##################################################################
```

FIGURE 3.51E

```
3.52 LRP5_SLC22A24
111TTAGGC_4   +chr11:68133170_-chr11:62863578    LRP5_SLC22A24    fusion_template
*************                                                     ******************************************************************
```

```
############################################
#########
111TTAGGC_4   +chr11:68133170_-chr11:62863578    LRP5_SLC22A24
              acceptor_genomic_template
**************
ACACATTATTGACATCTCACAAATGCTTGTTGTTATTTTTGTTGCTGAAG|CTTGTGAGATCCACCATGAAGAGGAGTTGGATGCAGT
CCGAATTAAAAC junction_-chr11_62863578_NM_001136506
##########################
#######

FIGURE 3.52C 3.53 C1orf109_MACF1
111TTAGGC_4   -chr1:38155278_+chr1:39792890  C1orf109_MACF1 fusion_template
********************
AAGCAGCTGGTGGCTGGTGACATCGTCCTGGACAAGCTAGGGAAAGGCT|GCTCTCAGAAAAGAGAAGAAACAAATATCTGAGCAAT
TGAATGCCCTAA junction_-chr1_38155278_+chr1_39792890_NM_017850 NM_012090
           --GGTGACATCGTCCTGGACAAGCTAGGGAAAGGCT|GCTCTCAGAAAAGA----------
           SEQUENCER02:111:B815YKABXX:4:1107:16438:27508
           ------GGACAAGCTAGGGAAAGGCT|GCTCTCAGAAAAGAGAAGAAACAAATAT------
           SEQUENCER02:111:B815YKABXX:4:1103:10339:55599
           ------GGACAAGCTAGGGAAAGGCT|GCTCTCAGAAAAGAGAAGAAACAAATAT------
           SEQUENCER02:111:B815YKABXX:4:1204:16050:86011
###########################
#######
111TTAGGC_4   -chr1:38155278_+chr1:39792890  C1orf109_MACF1 donor_template
********************
AAGCAGCTGGTGGCTGGTGACATCGTCCTGGACAAGCTAGGGAAAGGCT|AGCCATCCTCCTCAAGGTGCGAGACATGGTCAGCAGCC
ATGTGGAGCGAG junction_-chr1_38155278_-chr1_38152124_NM_017850
##########################

FIGURE 3.53A
```

```
111TTAGGC_4      -chr1:38155278_+chr1:39792890_C1orf109_MACF1_acceptor_template
***********************************************************************************
TCTGAAGCTATTAAAACATCACAGATCTTCTTGGCCAAGCATGGTCATAA|GCTCTCAGAAAAGAAGAAGAAACAAATATCTGAGCAAT
###################################################|##################################
TGAATGCCCTAA    junction_+chr1_39790406_+chr1_39792890_NM_012090
################################################################################
#########

111TTAGGC_4      -chr1:38155278_+chr1:39792890_C1orf109_MACF1_donor_genomic_template
***********************************************************************************
AAGCAGCTGGTGGCTGGTGACATCGTCCTGGACAAGCTAGGGAAAGGCT|GTAAGCAGCTCCCTAGTGCTGTTTCTTGTGGAAGGAT
###############################################|######################################
TTTAAAACGAGG    junction_-chr1_38155278_NM_017850
-----------GGCTGGTGACATCGTCCTGGACAAGCTAGGGAAAGGCT|GTAAGCAGCTC------------------------
           *************************************|*******************
           SEQUENCER02:111:B815YKABXX:4:1206:17641:153423

111TTAGGC_4      -chr1:38155278_+chr1:39792890_C1orf109_MACF1_acceptor_genomic_template
***********************************************************************************
GGAGATTGTTTTTTTTCTCCTAAAAAGCTTTAATGCTTCATCTTCCAG|GCTCTCAGAAAAGAAGAGAGAAACAAATATCTGAGCAAT
###############################################|######################################
TGAATGCCCTAA    junction_+chr1_39792890_NM_012090
################################################################################
##########
```

FIGURE 3.53B

```
3.54 KIF16B_PCSK2
111TTAGGC_5      -chr20:16553874_+chr20:172240885   KIF16B_PCSK2  fusion_template
***********************************************************************************
GCGATGGCATCGGTCAAGGTGGCCGTGGCCGTGAGGGTCCGGCCCATGAATCGCAG|CTTCCCTTTGCTGAAGGTCTGTACCACTTTTATCACAA
########################################################|#############################
TGGCCTTGCAAA    junction_-chr20_16553874_+chr20_172240885_NM_024704_NM_002594
------------CCGGCCATGAATCGCAG|CTTCCCTTTGCTGAAGGTCTGTACCACTTTTA-------
             ****************|************************************
             SEQUENCER02:111:B815YKABXX:5:2106:16839:45630
```

```
3.55 TXLNA_MARCH6
111TTAGGC_7    +chr1:32650217_+chr5:10433706 TXLNA_MARCH6  fusion_template
************************************************************************
GTACCCCAGAGGAGAAGCTGGCTGCTCTGTGCAAGAAGTATGCTGAACTG|GTACCTTGTGGGTCAACGACTCGTGAACTACGAACGGA
AATCTGGCAAAC    junction_+chr1_32650217_+chr5_10433706_NM_175852_NM_005885
------------    -GGCTGCTCTGTGCAAGAAGTATGCTGAACTG|GTACCTTGTGGGTCAACGA-----------------
------------    SEQUENCER02:111:B815YKABXX:7:1204:5543:23862
------------    -GGCTGCTCTGTGCAAGAAGTATGCTGAACTG|GTACCTTGTGGGTCAACGA-----------------
------------    SEQUENCER02:111:B815YKABXX:7:2106:6535:16398
------------    -CTGTGCAAGAAGTACGCTGAACTG|GTACCTTGTGGGTCAACGACTCGTGA---------------
------------    SEQUENCER02:111:B815YKABXX:7:1103:5899:183037
------------    -CTGTGCAAGAAGTACGCTGAACTG|GTACCTTGTGGGTCAACGACTCGTGA---------------
------------    SEQUENCER02:111:B815YKABXX:7:2102:7670:124702

111TTAGGC_7    +chr1:32650217_+chr5:10433706 TXLNA_MARCH6  donor_template
************************************************************************
GTACCCCAGAGGAGAAGCTGGCTGCTCTGTGCAAGAAGTATGCTGAACTG|CTGGAGGAGCACCGGAATTCACAGAAGCAGATGAAGCT
CCTACAGAAAAA    junction_+chr1_32650217_+chr1_326535555_NM_175852
------------    -GGCTGCTCTGTGCAAGAAGTATGCTGAACTG|CTGGAGGAGCACCGGAATT---------------
------------    SEQUENCER02:111:B815YKABXX:7:1205:9427:192799
------------    -GGCTGCTCTGTGCAAGAAGTATGCTGAACTG|CTGGAGGAGCACCGGAATT---------------
------------    SEQUENCER02:111:B815YKABXX:7:2203:6099:111436
------------    -CTGTGCAAGAAGTATGCTGAACTG|CTGGAGGAGCACCGGAATTCACAGAA------------
------------    SEQUENCER02:111:B815YKABXX:7:2104:14149:50595
------------    ----GTGCAAGAAGTATGCTGAACTG|CTGGAGGAGCACTGGAATTCACAGAAGC----------
------------    SEQUENCER02:111:B815YKABXX:7:1104:4896:73694
```

```
                                                  -------GTGCAAGAAGTATGCTGAACTG|GTCAGTTCCCCCTCCGGGGCACCTTC-------
                              SEQUENCER02:111:B815YKABXX:7:2103:13572:69021
                                                  -------GTGCAAGAAGTATGCTGAACTG|GTCAGTTCCCCCTCCGGGGCACCTTC-------
                              SEQUENCER02:111:B815YKABXX:7:2103:6040:46627
##########################################################################################
111TTAGGC_7     +chr1:32650217_+chr5:10433706  TXLNA_MARCH6    acceptor_genomic_template
****************************************************************************************
TACTCTGTACATTCATAGAAGAGAGTAACCACCTTGTTTTGCAACCTAG|GTACCTTGTGGGTCAACGACTCGTGAACTACGAACGGA
AATCTGGCAAAC  junction +chr5_10433706_NM_005885
##########################################################################################
```

FIGURE 3.55C

```
3.56 ACACA_MSI2
111TTAGGC_7     -chr17:35536201_+chr17:55478740    ACACA_MSI2    fusion_template
*******************************************************************************************
ATGATCAAGTGCAGCTGGTCCACATGAACAGGCTTCCAGGAGGAAATGAG|ATGGTCACAAGAACAAAGAAAATATTTGTAGGCGGGTT
ATCTGCGAACAC  junction -chr17_35536201_+chr17_55478740_NM_198834_NM_138962
             -------CAGCTGGTCCACATGAACAGGCTTCCAGGAGGAAATGAG|ATGGTCACAAG-------
              SEQUENCER02:111:B815YKABXX:7:1102:13373:119947
             -------CAGCTGGTCCACATGAACAGGCTTCCAGGAGGAAATGAG|ATGGTCACAAG-------
              SEQUENCER02:111:B815YKABXX:7:1103:14742:161589
             -------CAGCTGGTCCACATGAACAGGCTTCCAGGAGGAAATGAG|ATGGTCACAAG-------
              SEQUENCER02:111:B815YKABXX:7:1106:19680:89680
             -------CAGCTGGTCCACATGAACAGGCTTCCAGGAGGAAATGAG|ATGGTCACAAG-------
              SEQUENCER02:111:B815YKABXX:7:2105:5153:106616
             -------CAGCTGGTCCACATGAACAGGCTTCCAGGAGGAAATGAG|ATGGTCACAAG-------
              SEQUENCER02:111:B815YKABXX:7:2202:13973:5052
             -------CAGCTGGTCCACATGAACAGGCTTCCAGGAGGAAATGAG|ATGGTCACAAG-------
              SEQUENCER02:111:B815YKABXX:7:2205:1267:17372
```

FIGURE 3.56A

```
                                    ----GGTCCACATGAACATGAACAGGCTTCCAGGAGGAAATGAGIATGGTCACAAGAACAA---------------
                                        SEQUENCER02:111:B815YKABXX:7:1104:20411:23408
                                    ----GGTCCACATGAACATGAACAGGCTTCCAGGAGGAAATGAGIATGGTCACAAGAACAA---------------
                                        SEQUENCER02:111:B815YKABXX:7:2207:10525:10365
                                    --------TCCAGGAGGAAATGAGIATGGTCACAAGAACAAAGAAAATATTTGTAGGCG---------------
                                        SEQUENCER02:111:B815YKABXX:7:2108:3369:86707
##############################################################################################
############
111TTAGGC_7  -chr17:35536201_+chr17:55478740    ACACA_MSI2    donor_template
*************************************************************************************
ATGATCAAGGTCAGCTGGTCCACATGAACAGCTTCCAGGAGGAAATGAG|ATTGGCATGGTAGCTTGGAAAATGACCTTTAAAAGTCC
TGAATATCCAGA    junction_-chr17_35536201_-chr17_35518964_NM_198834
                                    ----GGTCCACATGAACAGGCTTCCAGGAGGAAATGAG|ATTGGCATGGTAGCTT----
                                        SEQUENCER02:111:B815YKABXX:7:1103:2583:135770
                                    ----GGTCCACATGAACAGGCTTCCAGGAGGAAATGAG|ATTGGCATGGTAGCTT----
                                        SEQUENCER02:111:B815YKABXX:7:2203:15903:98256
                                    ----GGTCCACATGAACAGCCTTCCAGGAGGAAATGAG|ATTGGCATGGTAGCTT----
                                        SEQUENCER02:111:B815YKABXX:7:2208:3671:129663
                                    ------CCACATGAACAGCCTTCCAGGAGGAAATGAG|ATTGGCATGGTAGCTTGGA-
                                        SEQUENCER02:111:B815YKABXX:7:2204:5749:103900
                                    ------CCACATGAACAGCCTTCCAGGAGGAAATGAG|ATTGGCATGGTAGCTTGGA-
                                        SEQUENCER02:111:B815YKABXX:7:2208:20198:12651
                                    --------ACAGGCTTCCAGGAGGAAATGAG|ATTGGCATGGTAGCTTGGAAAATGAC
                                        SEQUENCER02:111:B815YKABXX:7:1107:17296:89709
                                    --------ACAGGCTTCCAGGAGGAAATGAG|ATTGGCATGGTAGCTTGGAAAATGAC
                                        SEQUENCER02:111:B815YKABXX:7:1208:2280:97026
                                    --------ACAGGCTTCCAGGAGGAAATGAG|ATTGGCATGGTAGCTTGGAAAATGAC
                                        SEQUENCER02:111:B815YKABXX:7:2107:6580:19008
                                    --------ACAGGCTTCCAGGAGGAAATGAG|ATTGGCATGGTAGCTTGGAAAATGAC
                                        SEQUENCER02:111:B815YKABXX:7:2201:17893:86640
                                    --------ACAGGCTTCCAGGAGGAAATGAG|ATTGGCATGGTAGCTTGGAAAATGAC
                                        SEQUENCER02:111:B815YKABXX:7:2206:6400:190842
```

FIGURE 3.56B

```
                    ---------ACAGGCTTCCAGGAGGAAATGAG|ATTGGCATGGTAGCTTGGAAAATGAC-------
         SEQUENCER02:111:B815YKABXX:7:2207:7763:193952
                    ----CAGGCTTCCAGGAGGAAATGAG|ATTGGCATGGTAGCTTGGAAAATGACC------
         SEQUENCER02:111:B815YKABXX:7:1105:7157:25353
                    -----TCCAGGAGGAAATGAG|ATTGGCATGGTAGCTTGGAAAATGACCTTTAAAA----
         SEQUENCER02:111:B815YKABXX:7:1108:18158:184719
                    --------AGGAGGAAATGAG|ATTGGCATGGTAGCTTGGAAAATGACCTTTAAAAGTC-
         SEQUENCER02:111:B815YKABXX:7:1106:10847:98697
                    --------AGGAGGAAATGAG|ATTGGCATGGTAGCTTGGAAAATGACCTTTAAAAGTC-
         SEQUENCER02:111:B815YKABXX:7:1108:16914:113795
                    --------AGGAGGAAATGAG|ATTGGCATGGTAGCTTGGAAAATGACCTTTAAAAG---
         SEQUENCER02:111:B815YKABXX:7:1201:3974:129750
                    --------AGGAGGAAATGAG|ATTGGCATGGTAGCTTGGAAAATGACCTTTAAAAGTC-
         SEQUENCER02:111:B815YKABXX:7:1204:3415:23876
                    --------AGGAGGAAATGAG|ATTGGCATGGTAGCTTGGAAAATGACCTTTAAAAGTC-
         SEQUENCER02:111:B815YKABXX:7:1206:17826:34845
                    --------AGGAGGAAATGAG|ATTGGCATGGTAGCTTGGAAAATGACCTTTAAAAGTC-
         SEQUENCER02:111:B815YKABXX:7:2101:17197:108318
                    --------AGGAGGAAATGAG|ATTGGCATGGTAGCTTGGAAAATGACCTTTAAAAGTC-
         SEQUENCER02:111:B815YKABXX:7:2105:7389:59160
                    --------AGGAGGAAATGAG|ATTGGCATGGTAGCTTGGAAAATGACCTTTAAAAGT--
         SEQUENCER02:111:B815YKABXX:7:2106:11722:190379
                    --------AGGAGGAAATGAG|ATTGGCATGGTAGCTTGGAAAATGACCTTTAAAAGTC-
         SEQUENCER02:111:B815YKABXX:7:2108:20575:70339
###################################################################################
111TTTAGGC_7   -chr17:35536201_+chr17:55478740    ACACA_MSI2    acceptor_template
***********************************************************************************
CCAAGAGACGATTGACCCCAAAGTTGCATTTCCTCGTCGAGCGCAAGG|ATGGTCACAAGAACAAAGAAATATTTGTAGGCGGGTT
ATCTGCGAACAC  junction_+chr17_55339553_+chr17_55478740_NM_138962
###################################################################################

FIGURE 3.56C
```

FIGURE 3.56D 3.57 CREB1_TMEM131

```
113GCCAAT_2  +chr2:208435045_-chr2:98543950        CREB1_TMEM131_fusion_template
********************************************************************************
CACTGTAACGGTGCCAACTCCAATTTACCAAACTAGCAGTGGACAGTATA|CATTCGTTCAGTCAGAGAGCATAATAGAAGTACTGCGT
TTTGATGATGGA    junction_+chr2_208435045_-chr2_98543950_NM_004379_NM_015348
         ------AGCAGTGGACAGTATA|CATTCGTTCAGTCAGAGAGCATAATAGAAGTACT---
         SEQUENCER02:113:A815WVABXX:2:1101:13379:6119
         ------AGCAGTGGACAGTATA|CATTCGTTCAGTCAGAGAGCATAATAGAAGTACT---
         SEQUENCER02:113:A815WVABXX:2:1102:17052:64029
         ------AGCAGTGGACAGTATA|CATTCGTTCAGTCAGAGAGCATAATAGAAGTACT---
         SEQUENCER02:113:A815WVABXX:2:1103:13675:60862
         ------AGCAGTGGACAGTATA|CATTCGTTCAGTCAGAGAGCATAATAGAAGTACT---
         SEQUENCER02:113:A815WVABXX:2:1103:19436:14827
         ------AGCAGTGGACAGTATA|CATTCGTTCAGTCAGAGAGCATAATAGAAGTACT---
         SEQUENCER02:113:A815WVABXX:2:1107:15428:193073
         ------AGCAGTGGACAGTATA|CATTCGTTCAGTCAGAGAGCATAATAGAAGTACT---
         SEQUENCER02:113:A815WVABXX:2:1108:14786:10434
         ------AGCAGTGGACAGTATA|CATTCGTTCAGTCAGAGAGCATAATAGAAGTACT---
         SEQUENCER02:113:A815WVABXX:2:1202:11623:34222
         ------AGCAGTGGACAGTATA|CATTCGTTCAGTCAGAGAGCATAATAGAAGTACT---
         SEQUENCER02:113:A815WVABXX:2:1205:4250:33008
         ------AGCAGTGGACAGTATA|CATTCGTTCAGTCAGAGAGCATAATAGAAGTACT---
         SEQUENCER02:113:A815WVABXX:2:1207:17468:69507
         ------AGCAGTGGACAGTATA|CATTCGTTCAGTCAGAGAGCATAATAGAAGTACT---
         SEQUENCER02:113:A815WVABXX:2:2101:9110:133980
         ------AGCAGTGGACAGTATA|CATTCGTTCAGTCAGAGAGCATAATAGAAGTACT---
         SEQUENCER02:113:A815WVABXX:2:2104:19577:189257
         ------AGCAGTGGACAGTATA|CATTCGTTCAGTCAGAGAGCATAATAGAAGTACT---
         SEQUENCER02:113:A815WVABXX:2:2104:5953:54310
         ------AGCAGTGGACAGTATA|CATTCGTTCAGTCAGAGAGCATAATAGAAGTACT---
         SEQUENCER02:113:A815WVABXX:2:2105:8084:76814
```

```
                                            ------GGCGCGGGCCGAGAAGGAAG|CATTCGTTCAGTCAGAGAGCATAGTAGAAG-----
             SEQUENCER02:113:A815WVABXX:2:2105:16264:174857
                                            ------GGCGCGGGCCGAGAAGGAAG|CATTCGTTCAGTCAGAGAGCATAATAGAAG-----
             SEQUENCER02:113:A815WVABXX:2:2204:13257:67581
                                            ------GGCGCGGGCCGAGAAGGAAG|CATTCGTTCAGTCAGAGAGCATAATAGAAG-----
             SEQUENCER02:113:A815WVABXX:2:2204:6800:35995
                                            ---------CGGGCCGAGAAGGAAG|CATTCGTTCAGTCAGAGAGCATAATAGAAGTACT----
             SEQUENCER02:113:A815WVABXX:2:1106:2284:184798
                                            ---------CGGGCCGAGAAGGAAG|CATTCGTTCAGTCAGAGAGCATAATAGAAGTACT----
             SEQUENCER02:113:A815WVABXX:2:1206:17394:169087
                                            ---------CGGGCCGAGAAGGAAG|CATTCGTTCAGTCAGAGAGCATAATAGAAGTACT----
             SEQUENCER02:113:A815WVABXX:2:1206:18152:47375
                                            ---------CGGGCCGAGAAGGAAG|CATTCGTTCAGTCAGAGAGCATAATAGAAGTACT----
             SEQUENCER02:113:A815WVABXX:2:2105:10735:172329
                                            ---------CGGGCCGAGAAGGAAG|CATTCGTTCAGTCAGAGAGCATAATAGAAGTACT----
             SEQUENCER02:113:A815WVABXX:2:2204:17867:140071
GAGAAGGAAG|CATTCGTTCAGTCAGAGAGTATAATAGAAGTACTGCGTTT------
             SEQUENCER02:113:A815WVABXX:2:1104:10121:174267
##########################################################    CREB1_TMEM131_donor_genomic_template
113GCCAAT_2   +chr2:208435045_-chr2:98543950
**************************************************************
CACTGTAACGGTGCCAACTCCAATTTACCAAACTAGCAGTGGACAGTATA|GTGAGTAATAGACAATTTCTGTTTCTATTGTGAGGAGA
AAAAAGTGAGA  junction_+chr2_208435045_NM_004379
----------   ------AGCAGTGGACAGTATA|GTGAGTAATAGACAATTTCTGTTTCTATTGTGAG---
             SEQUENCER02:113:A815WVABXX:2:1102:10767:68707
----------   ------AGCAGTGGACAGTATA|GTGAGTAATAGACAATTTCTGTTTCTATTGTGAG---
             SEQUENCER02:113:A815WVABXX:2:1203:20707:41208
TGGACAGTATA|GTGAGTAATAGACAATTTCTGTTTCTATTGTGAGGAGAA----------
             SEQUENCER02:113:A815WVABXX:2:2102:12208:132235
```

FIGURE 3.57C

```
------GGACAGTATA|GTGAGTAATAGACACAATTTCTGTTTCTATTGTGAGGAGAAA------
         SEQUENCER02:113:A815WVABXX:2:1105:3171:86805
------
------GGACAGTATA|GTGAGTAATAGACACAATTTCTGTTTCTATTGTGAGGAGAAA------
         SEQUENCER02:113:A815WVABXX:2:2103:5729:37518
------
ACAGTATA|GTGAGTAATAGACACAATTTCTGTTTCTATTGTGAGGAGAAA------
         SEQUENCER02:113:A815WVABXX:2:2103:9735:133307
###############################################################
#########
113GCCAAT_2     +chr2:208435045_-chr2:98543950     CREB1_TMEM131
  acceptor_genomic_template
***************************************************************
*********
AATCAAATTTATGTTCCTGTAAGTGATGGTATGTTTGTTTCTTCACAG|CATTCGTTCAGTCAGAGAGCATAATAGAAGTACTGCGT
TTTGATGATGA    junction_-chr2_98543950_NM_015348
###############################################################

```

FIGURE 3.57D

3.58 SFXN1_CAMK4
```
113GCCAAT_2    +chr5:174905642_+chr5:1107823845    SFXN1_CAMK4    fusion_template
***************************************************************************
TGCACTGAGCGGACCTGCGACAGCGCGGGCGGCAGCCCGGGGAAGCG|TATCTACATGAAAATGGGATTGTCCATCGTGATCTCAA
ACCAGAGAATCT  junction_+chr5_174905642_+chr5_110782384_NM_022754_NM_001744
---------------GCGGCAGCCCGGGGAAGCG|TATCTACATGAAAATGGGATTGTCCATCGT------
         SEQUENCER02:113:A815WVABXX:2:1106:6584:122035
---------------GCGGCAGCCCGGGGAAGCG|TATCTACATGAAAATGGGATTGTCCATCGT------
         SEQUENCER02:113:A815WVABXX:2:1205:18115:157791
---------------GCGGCAGCCCGGGGAAGCG|TATCTACATGAAAATGGGATTGTCCATCGT------
         SEQUENCER02:113:A815WVABXX:2:1206:6400:45858
```

FIGURE 3.58A

```
                    ------------------------------GCGGCAGCCCGGGGAAGCG|TATCTACATGAAAATGGGATTGTCCATCGT-------------
                    SEQUENCER02:113:A815WVABXX:2:1207:5064:59216
                    ------------------------------GCGGCAGCCCGGGGAAGCG|TATCTACATGAAAATGGGATTGTCCATCGT-------------
                    SEQUENCER02:113:A815WVABXX:2:2208:5892:153829
##############################################################################
113GCCAAT_2    +chr5:174905642_+chr5:1107823 84    SFXN1_CAMK4    donor_template
*****************************************************************************

TGCACTGAGCGGGACCTGCGAGCAGCGGCGGCAGCCCGGGGAAGCG|TCCGGGACCATGTCTGGAGAACTACCACCAAACATTAA
CATCAAGGAACC  junction +chr5_174905642_+chr5_174919098_NM_022754
################################################################################
113GCCAAT_2    +chr5:174905642_+chr5:1107823 84    SFXN1_CAMK4    acceptor_template
*****************************************************************************

GTGAGCGAGATGCTGCAGATGCCGTTAAACAAATCCTGGAGGCAGTTGCT|TATCTACATGAAAATGGGATTGTCCATCGTGATCTCAA
ACCAGAGAATCT  junction +chr5_110730480_+chr5_110782384_NM_001744
################################################################################
113GCCAAT_2    +chr5:174905642_+chr5:1107823 84    SFXN1_CAMK4    donor_genomic_template
*****************************************************************************

TGCACTGAGCGGGACCTGCGAGCAGCGGCGGCAGCCCGGGGAAGCG|GTGAGTCGCGGGCGGCAGCCCAGGTGGGTGGGG
AAACGCGCAGGG  junction +chr5_174905642_NM_022754
################################################################################
113GCCAAT_2    +chr5:174905642_+chr5:1107823 84    SFXN1_CAMK4    acceptor_genomic_template
*****************************************************************************
```

FIGURE 3.58B

The page content is rotated 90°. It contains sequence alignment data for figures 3.58C and 3.59A.

FIGURE 3.58C

```
AACCATAAATAGCATTACACAAATGTTATTTCATTATTTCCCTCTTTAG|TATCTTACACATGAAAAATGGGATTGTCCATCGTGATCTCAA
ACCAGAGAATCT    junction +chr5_1107782384_NM_001744
###############################################################################
##############
```

3.59 FAM135A_PKIB

```
113GCCAAT_2      +chr6:71123405_+chr6:123038932         FAM135A_PKIB  fusion_template
***************************************************************************************
***************

ACGAGCTCCTCCGTTCGACAGGCGGGGAAGAGGCCGAGCCGGGCGAGAG|ATGTTGCTATGAGGACAGATTCATCAAAAATGACTGAC
GTGGAGTCTGGG    junction_+chr6_71123405_+chr6_123038932_NM_020819_NM_032471
###############################################################################
----------GGGGAAGAGGCCGAGCCGGGCGAGAG|ATGTTGCTATGAGGACAGATTC------------------
           SEQUENCER02:113:A815WVABXX:2:1201:16843:124190
----------GGGGAAGAGGCCGAGCCGGGCGAGAG|ATGTTGCTATGAGGACAGATTC------------------
           SEQUENCER02:113:A815WVABXX:2:2107:7834:94774
###############################################################################

113GCCAAT_2      +chr6:71123405_+chr6:123038932         FAM135A_PKIB  donor_template
***************************************************************************************
***********

ACGAGCTCCTCCGTTCGACAGGCGGGGAAGAGGCCGAGCCGGGCGAGAG|GGGGAACGGTGTATTTTTAACAACGGGAATCAGTAACT
GAAGTACAAGA    junction +chr6_71123405_+chr6_71136142_NM_020819
###############################################################################

113GCCAAT_2      +chr6:71123405_+chr6:123038932         FAM135A_PKIB  acceptor_template
***************************************************************************************
***********

TAACTCTGGGAGAAGCAGAAAACCCTGTGCCAGGGACAGAGAAAGATAGGA|ATGTTGCTATGAGGACAGATTCATCAAAAATGACTGAC
GTGGAGTCTGGG    junction_+chr6_122954512_+chr6_123038932_NM_032471
###############################################################################

113GCCAAT_2      +chr6:71123405_+chr6:123038932         FAM135A_PKIB  donor_genomic_template
***************************************************************************************
**************
```

FIGURE 3.59A

```
ACGAGCTCCTCCGTTCGACAGGCGGGGAAGAGAGGCCGAGCCGGGCGAGAG|GTAACCCCCTTACTGTCCCCTCTGGCTCCCCCGGCTCC
CGACACCCACGA    junction_+chr6_71123405_NM_020819           -------------
###############################################################################
GCCGGGCGAGAG|GTAACCCCCTTACTGTCCCCTCTGGCTCCCCCTGGCTCC-----------
    SEQUENCER02:113:A815WVABXX:2:2203:12065:97906
###############################################################################
113GCCAAT_2    +chr6:71123405_+chr6:123038932        FAM135A_PKIB
     acceptor_genomic_template
*******************************************************************************
ATTTACTTCTGAATAGGCTCATCTTCTTCATATGCACATTCTATTTGTAG|ATGTTGCTATGAGGACAGATTCATCAAAAATGACTGAC
GTGGAGTCTGGG    junction_+chr6_123038932_NM_032471
###############################################################################

FIGURE 3.59B 3.60 KLHDC4_LRPAP1
113GCCAAT_3    -chr16:877760371_-chr4:3526778 KLHDC4_LRPAP1  fusion_template
*******************************************************************************
CCGTCACTCCCCCAGGCGGGCATCGTCGTCTATGGGGGCTACTCGAAACAG|CTGCATCTTCCTCCCGTGAGGCTGGCCGAGCTCCACGC
TGATCTGAAGAT    junction_-chr16_87760371_-chr4_3526778_NM_002337
------------------ATGGGGGCTACTCGAAACAG|CTGCATCTTCCTCCCGTGAGGCTGGCCGAG-------
    SEQUENCER02:113:A815WVABXX:3:2107:19676:152236
------------------ATGGGGGCTACTCGAAACAG|CTGCATCTTCCTCCCGTGAGGCTGGCCGAG-------
    SEQUENCER02:113:A815WVABXX:3:2206:2876:173562
###############################################################################
113GCCAAT_3    -chr16:877760371_-chr4:3526778 KLHDC4_LRPAP1  donor_template
*******************************************************************************

FIGURE 3.60A
```

```
CCGTCACTCCCCAGGGCGGCATCGTCGTCTATGGGGCTACTCGAAACAG|AGAGTTAAGAAAGACGTGGACAAGGGCACACGGCACTC
AGACATGTTCCT       junction_-chr16_87760371_-chr16_87748179_NM_017566
------------       ---GGCATCGTCGTCTATGGGGCTACTCGAAACAG|AGAGTTAAGAAAGACGT--------------------
------------       SEQUENCER02:113:A815WVABXX:3:2206:7616:130028
------------       -------------ATGGGGCTACTCGAAACAG|AGAGTTAAGAAAGACGTGGACAAGGGCACA---------
------------       SEQUENCER02:113:A815WVABXX:3:1103:11992:102932
------------       -------------ATGGGGCTACTCGAAACAG|AGAGTTAAGAAAGACGTGGACAAGGGCACA---------
------------       SEQUENCER02:113:A815WVABXX:3:1103:2722:76456
------------       -------------ATGGGGCTACTTGAAACAG|AGAGTTAAGAAAGACGTGGACAAGGGCACA---------
------------       SEQUENCER02:113:A815WVABXX:3:1105:18512:53000
------------       -------------ATGGGGCTACTCGAAACAG|AGAGTTAAGAAAGACGTGGACAAGGGCACA---------
------------       SEQUENCER02:113:A815WVABXX:3:1106:20229:147912
------------       -------------ATGGGGCTACTCGAAACAG|AGAGTTAAGAAAGACGTGGACAAGGGCACA---------
------------       SEQUENCER02:113:A815WVABXX:3:2105:14741:18111
------------       -------------ATGGGGCTACTCGAAACAG|AGAGTTAAGAAAGACGTGGACAAGGGCACA---------
------------       SEQUENCER02:113:A815WVABXX:3:2208:14800:108189
#########    ################################################################
################
113GCCAAT_3        -chr16:87760371_-chr4:3526778 KLHDC4_LRPAP1  acceptor_template
***********        ****************************************************************
AGGAGTTCCGCATGGAGAAGTTGAACCAGCTGTGGGAGAAGCCCAGCGA|CTGCATCTTCCTCCCGTGAGGCTGGCCGAGCTCCACGC
TGATCTGAAGAT       junction__-chr4_3533936_-chr4_3526778_NM_002337
------------       -----TGTGGGAGAAGCCCAGCGA|CTGCATCTTCCTCCCGTGAGGCTGGCCGAGCTCGAG---------
------------       SEQUENCER02:113:A815WVABXX:3:1107:18387:155061
------------       ------------GTGGGAGAAGCCCAGCGA|CTGCATCTTCCTCCCGTGAGGCTGGCCGAGC---------
------------       SEQUENCER02:113:A815WVABXX:3:1105:19633:167908
------------       ------------GTGGGAGAAGCCCAGCGA|CTGCATCTTCCTCCCGTGAGGCTGGCCGAGC---------
------------       SEQUENCER02:113:A815WVABXX:3:1202:4696:57321
------------       ----AAGGCCCAGCGA|CTGCATCTTCCTCCCGTGAGGCTGGCCGAGCTCCACG-
------------       SEQUENCER02:113:A815WVABXX:3:1104:1646:100894
------------       ----AAGGCCCAGCGA|CTGCATCTTCCTCCCGTGAGGCTGGCCGAGCTCCACG-
------------       SEQUENCER02:113:A815WVABXX:3:2201:13521:186987
```

FIGURE 3.60B

```
       AGGCCCAGCGA|CTGCATCTTCCTCCCGTGAGGCTGGCCGAGCTCCACGC---------
               SEQUENCER02:113:A815WVABXX:3:1204:18909:33176
       -----------------------------------------------------------
       AGGCCCAGCGA|CTGCATCTTCCTCCCGTGAGGCTGGCCGAGCTCCACGCT--------
               SEQUENCER02:113:A815WVABXX:3:2103:15716:46039
       ###########################################################
113GCCAAT_3    -chr16:877760371_-chr4:3526778 KLHDC4_LRPAP1 donor_genomic_template
       ***********************************************************
       CCGTCACTCCCCAGGGCGCATCGTCGTCTATGGGGCTACTCGAAACAG|GTAAGGCGGGGGG
       CGGGAAACAGGC   junction_-chr16_877760371_NM_017566
       ###########################################################
113GCCAAT_3    -chr16:877760371_-chr4:3526778 KLHDC4_LRPAP1 acceptor_genomic_template
       ***********************************************************
       TCCTGTCCGTCCTGCTCGTGGCTCACAGGCCTCCTCCCCCTTCGCAG|CTGCATCTTCCTCCCGTGAGGCTGGCCGAGCTCCACGC
       TGATCTGAAGAT   junction_-chr4_3526778_NM_002337
       ###########################################################
```

FIGURE 3.60C

3.61 DIP2B_LINC00330
```
113GCCAAT_4    +chr12:51034635_-chr13:45379166    DIP2B_LINC00330    fusion_template
       ***********************************************************
       GTACCACCGAACTCGATCGGGGGAGCCAGGGATGAACGATATCGATCAG|AGTCTTGCTCTGTCCGCCCAGGCTGGAGTGCAGTGGTGC
       GACCTTGGCTCA   junction_+chr12_51034635_-chr13_45379166_NM_173602_NR_038433
       -----------------------------------------------------------
       -----GGGGGAGCCAGGGATGAACGATATCGATCAG|AGTCTTGCTCTGTCGCCCA-----
               SEQUENCER02:113:A815WVABXX:4:1208:12996:172576
```

FIGURE 3.61A

```
###############################################################################################
###############
113GCCAAT_4    +chr12:51034635_-chr13:45379166       DIP2B_LINC00330    donor_template
***********************************************************************************************
GTACCACCGAACTCGATCTGGGGAGCCAGGATGAACGATATCGATCAG|ATATCCACACAGAAGCAGTTCAGGCTGCACTGGCAAAG
CATAAGAACAG       junction +chr12_51034635_+chr13_51053977_NM_173602
-----CTGGGGAGCCAGGATGAACGATATCGATCAG|ATATCCACACAGAAGCA------------------------------------
          SEQUENCER02:113:A815WVABXX:4:1107:20182:27962
------TGGGGAGCCAGGATGAACGATATCGATCAG|ATATCCACACAGAAGCAG-----------------------------------
          SEQUENCER02:113:A815WVABXX:4:1102:9393:71981
------TGGGGAGCCAGGATGAACGATATCGATCAG|ATATCCACACAGAAGCAG-----------------------------------
          SEQUENCER02:113:A815WVABXX:4:1105:16715:123221
------TGGGGAGCCAGGATGAACGATATCGATCAG|ATATCCACACAGAAGCAG-----------------------------------
          SEQUENCER02:113:A815WVABXX:4:1205:16843:147089
------TGGGGAGCCAGGATGAACGATATCGATCAG|ATATCCACACAGAAGCAG-----------------------------------
          SEQUENCER02:113:A815WVABXX:4:2105:1372:184840
------TGGGGAGCCAGGATGAACGATATCGATCAG|ATATCCACACAGAAGCAG-----------------------------------
          SEQUENCER02:113:A815WVABXX:4:2203:19646:194226
------TGGGGAGCCAGGATGAACGATATCGATCAG|ATATCCACACAGAAGCAG-----------------------------------
          SEQUENCER02:113:A815WVABXX:4:2208:9373:163519
-------GGGGGAGCCAGGATGAACGATATCGATCAG|ATATCCACACAGAAGCAGT---------------------------------
          SEQUENCER02:113:A815WVABXX:4:1102:16159:135974
-------GGGGGAGCCAGGATGAACGATATCGATCAG|ATATCCACACAGAAGCAGT---------------------------------
          SEQUENCER02:113:A815WVABXX:4:1105:20188:27140
-------GGGGGAGCCAGGATGAACGATATCGATCAG|ATATCCACACAGAAGCAG----------------------------------
          SEQUENCER02:113:A815WVABXX:4:1205:17925:22972
-------GGGGGAGCCAGGATGAACGATATCGATCAG|ATATCCACACAGAAGCAG----------------------------------
          SEQUENCER02:113:A815WVABXX:4:1205:20933:138470
-------GGGGGAGCCAGGATGAACGATATCGATCAG|ATATCCACACAGAAGCAGT---------------------------------
          SEQUENCER02:113:A815WVABXX:4:1205:2471:155438
-------GGGGGAGCCAGGATGAACGATATCGATCAG|ATATCCACACAGAAGCAGT---------------------------------
          SEQUENCER02:113:A815WVABXX:4:1205:9937:128331
```

FIGURE 3.61B

```
                                    ------GGGGGAGCCAGGAGGATGAACGATATCGATCAG-------------------------
------SEQUENCER02:113:A815WVABXX:4:2107:10623:53569
------SEQUENCER02:113:A815WVABXX:4:2203:4306:46549
------SEQUENCER02:113:A815WVABXX:4:2204:12136:26338
------SEQUENCER02:113:A815WVABXX:4:2204:7142:135588
------SEQUENCER02:113:A815WVABXX:4:2208:2625:135692
------SEQUENCER02:113:A815WVABXX:4:2208:6088:62789
------SEQUENCER02:113:A815WVABXX:4:2202:9627:182337
------SEQUENCER02:113:A815WVABXX:4:2207:8298:199682
---GGAGCCAGGAGGATGAACGATATCGATCAG|ATATCCACACAGAAGCAGTTCA----
------SEQUENCER02:113:A815WVABXX:4:2104:19075:109074
---GGAGCCAGGAGGATGAACGATATCGATCAG|ATATCCACACAGAAGCAGTTCA----
------SEQUENCER02:113:A815WVABXX:4:2202:14964:16127
---GGAGCCAGGAGGATGAACGATATCGATCAG|ATATCCACACAGAAGCAGTTCA----
------SEQUENCER02:113:A815WVABXX:4:2202:5707:66992
##################################################################
113GCCAAT_4    +chr12:51034635_-chr13:45379166    DIP2B_LINC00330    acceptor_template
****************************************************************
CATGAAGGTCCACGGCAGTCGAATCAGCCAAAGCACAAGACAAACACAA|AGTCTTGCTCTGTCGCCCAGGCTGGAGTGCAGTGGTGC
GACCTTGGCTCA    junction -chr13_45383545_-chr13_45379166_NR_038433
##################################################################
113GCCAAT_4    +chr12:51034635_-chr13:45379166    DIP2B_LINC00330
    donor_genomic_template
```

FIGURE 3.61C

```
***********************************************************************
********
GTACCACCGAACTCGATCTGGGGAGCCAGGAGATGAACGATATCGATCAG|GTGAGGAGAAGCTGCAGAATGGCCAGCTGAATCGTTTT
CCTAACAGTAGT    junction_+chr12_51034635_NM_173602
------------GGGGAGCCAGGAGATGAACGATATCGATCAG|GTGAGGAGAAGCTGCAGAA------------------------
                 SEQUENCER02:113:A815WVABXX:4:1202:12294:123200
------------GGGGAGCCAGGAGATGAACGATATCGATCAG|GTGAGGAGAAGCTGCAGAA------------------------
                 SEQUENCER02:113:A815WVABXX:4:2104:12801:198384
------------GGGGAGCCAGGAGATGAACGATATCGATCAG|GTGAGGAGAAGCTGCAGA-------------------------
                 SEQUENCER02:113:A815WVABXX:4:2204:5718:37068
###############################################################################
########
113GCCAAT_4   +chr12:51034635_ -chr13:45379166     DIP2B_LINC00330
   acceptor_genomic_template
***********************************************************************
********
TGAGGGTGTTGCCAAAGGAGATTAACATTTTTTTTTTCTTGCGACACAG|AGTCTTGCTCTGTCGCCCAGGCTGAGTGCAGTGGTGC
GACCTTGGCTCA   junction_-chr13_45379166_NR_038433
###############################################################################
########
```

FIGURE 3.61D

```
3.62 PDE4D_ITGA1
113GCCAAT_4   -chr5:58284320_ +chr5:52218607 PDE4D_ITGA1   fusion_template
***********************************************************************
********
ACATGATGTAGATCATCCTGGTGTCCAATCAATTTCTGATCAATACAA|GACAAGCATGACTTTCAGGACTCTGTGAGAATAACGTT
GGACTTTAATCT   junction_-chr5_58284320_+chr5_52218607_PDE4D_ITGA1|GACAAGCATGACTTTCAG------
------------TGGTGTGTCCAATCAATTTCTGATCAATACAA|GACAAGCATGACTTTCAG----NM_006203_NM_181501
                 SEQUENCER02:113:A815WVABXX:4:1102:19462:146757
------------GGTGTGTCCAATCAATTTCTGATCAATACAA|GACAAGCATGACTTTCAGG-----
                 SEQUENCER02:113:A815WVABXX:4:1104:13177:87861
```

FIGURE 3.62A

```
################################################################################
#############
113GCCAAT_4      -chr5:58284320_+chr5:52218607 PDE4D_ITGA1    donor_template
*******************************************************************************
*********
ACATGATGTAGATCATCCTGGTGTCCAATCAATTTCTGATCAATACAA|ACTCTGAACTTGCCTTGATGTACAATGATTCCTCAGTC
TTAGAGAACCAT   junction_-chr5_58284320_-chr5_58273172_NM_006203
---------------GGTGTGTCCAATCAATTTCTGATCAATACAA|ACTCTGAACTTGCCTTGAT---------------
---------       SEQUENCER02:113:A815WVABXX:4:2205:16993:38545
###############################################################################
###
113GCCAAT_4      -chr5:58284320_+chr5:52218607 PDE4D_ITGA1    acceptor_template
*******************************************************************************
*******
ACATCACACAGTTCGAAAATCAGAAATGCACTAAGCACTCCTTCTACATGTTG|GACAAGCATGACTTTCAGGACTCTGTGAGAATAACGTT
GGACTTTAATCT   junction_+chr5_52216298_+chr5_52218607_NM_181501
###############################################################################

113GCCAAT_4      -chr5:58284320_+chr5:52218607 PDE4D_ITGA1    donor_genomic_template
*******************************************************************************
*******
ACATGATGTAGATCATCCTGGTGTCCAATCAATTTCTGATCAATACAA|GTAAGTAAACTTTATTTTTTCAGAACACATTTTTCCCT
TGTACATTTTAG   junction_-chr5_58284320_NM_006203
###############################################################################

113GCCAAT_4      -chr5:58284320_+chr5:52218607 PDE4D_ITGA1    acceptor_genomic_template
*******************************************************************************
*******
ACACCCGGTAAATATGATACCAGTGATATATTTTATGTTTCACCCTCTAG|GACAAGCATGACTTTCAGGACTCTGTGAGAATAACGTT
GGACTTTAATCT   junction_+chr5_52218607_NM_181501
###############################################################################
#######
```

FIGURE 3.62B

3.63 PQLC1_LINC00330

```
113TTAGGC_6      -chr18:77710724_-chr13:45379166    PQLC1_LINC00330   fusion_template
*************************************************************************************
TACGTGTGCCTGGTGCTGCTGGTGCCAACATTTGCGGATACTCTTCTG|AGTCTTGCTCTGTCGCCCAGGCTGGAGTGCAGTGGTGC
GACCTTGGCTCA  junction -chr18_77710724_-chr13_45379166_NM_025078_NR_038433
--------GCTGGTGGCCAACAGTTTGCGGATACTCTTCTG|AGTCTTGCTCTGTCGCC--------------------------
              SEQUENCER02:113:A815WVABXX:6:2202:19732:84048
##############################################################################

113TTAGGC_6      -chr18:77710724_-chr13:45379166    PQLC1_LINC00330   donor_template
*************************************************************************************
TACGTGTGCCTGGTGCTGCTGGTGCCAACATTTGCGGATACTCTTCTG|GTTTGGAAGGCGCTTTGAGTCCCGCTGCTGTGGCAGA
GCGCCATCATGA  junction -chr18_77710724_-chr13_45379166_NM_025078
##############################################################################

113TTAGGC_6      -chr18:77710724_-chr13:45379166    PQLC1_LINC00330   acceptor_template
*************************************************************************************
CATGAAGGTCCACCGGCAGTCGAATCAGCCAAAGCACAAGACAAACACAA|AGTCTTGCTCTGTCGCCCAGGCTGGAGTGCAGTGGTGC
GACCTTGGCTCA  junction -chr13_45383545_-chr13_45379166_NR_038433
##############################################################################

113TTAGGC_6      -chr18:77710724_-chr13:45379166    PQLC1_LINC00330
*************************************************************************************
               donor_genomic_template
TACGTGTGCCTGGTGCTGCTGGTGCCAACATTTGCGGATACTCTTCTG|GTAAGTTGGGGGCTTGCTTTCCTGGCTGCACCCGGAG
AAGAGGGTTTCT  junction -chr18_77710724_NM_025078
##############################################################################
```

FIGURE 3.63A

```
113TTAGGC_6     -chr18:77710724  -chr13:45379166    PQLC1_LINC00330
                acceptor_genomic_template
****************************************************************************
****************

TGAGGGTGTTGCCAAAGGAGATTAACATTTTTTTTTCTTCTGCGACAG|AGTCTTGCTCTGTCGCCCAGGCTGGAGTCAGTGGTGC
GACCTTGGCTCA    junction_-chr13_45379166_NR_038433
############################################################################
################

FIGURE 3.63B 3.64 PPP1R12C_IFITM10
113TTAGGC_7     -chr19:55610152  -chr11:1769349    PPP1R12C_IFITM10    fusion_template
****************************************************************************
****************
ATGAGGAAGTACTGAGCCTGTTGGAGGAACTGGCCCGGCAGTGCCCAGGCCCCGGCCCCAGCCCCGCTGGGAGA
CCCGGCCAGCAC    junction_-chr19_55610152_-chr11_1769349_NM_017607_NM_001170820
----------------GGCCCGGCAGTGCCCAGGCCCCGGCCCCAGCCCCGCAGTGCCCAGCCCCGC--------
                SEQUENCER02:113:A815WVABXX:7:2107:3376:65561
----------------GGCCCGGCAGTGCCCAGGCCCCGGCCCCAGCCCCGCAGTGCCCAGCCCCGC--------
                SEQUENCER02:113:A815WVABXX:7:2207:18572:98397
################################################################
################
113TTAGGC_7     -chr19:55610152  -chr11:1769349    PPP1R12C_IFITM10    donor_template
****************************************************************************
****************
ATGAGGAAGTACTGAGCCTGTTGGAGGAACTGGCCCGGCAGTGCCCAGGCCCCGGCCCCAGCCCCGCGGGGCCA
GGAGCCCCAAGC    junction_-chr19_55610152_-chr11_1769349_NM_017607
############################################################################
################
113TTAGGC_7     -chr19:55610152  -chr11:1769349    PPP1R12C_IFITM10    acceptor_template
****************************************************************************
****************
```

FIGURE 3.64A

```
TCAGCTTCCGGGGACTTTGGAGAGGGTCAGGCTCAGTGGAGCTGGAG|GCCCAGGGCCCCGGCCCAGTGCCCAGCCCGCTGGGAGA
CCCGGCCAGCAC  junction_-chr11_1771589_-chr11_1769349_NM_001170820
###############################################|#######################################
113TTAGGC_7    -chr19:55610152_-chr11:1769349        PPP1R12C_IFITM10
             donor_genomic_template
*************************************************|*************************************

ATGAGGAAGTACTGAGCCTGTTGGAGGAACTGGCCCCGGAAACAGGAGGAC|GTGAGTGTCAGGGCTTACCCCAGACTCCCC
ATGTCCCCTCAG  junction_-chr19_55610152_NM_017607
##################################################|##############################
113TTAGGC_7    -chr19:55610152_-chr11:1769349        PPP1R12C_IFITM10
             acceptor_genomic_template
***************************************************|*****************************

GTGCTGGCCGGTAGCCCGGGCCCAGCTTGCTCTCACTTTCTCCTCTCCAG|GCCCAGGGCCCCGGCCCAGTGCCCAGCCCGCTGGGAGA
CCCGGCCAGCAC  junction_-chr11_1769349_NM_001170820
##################################################|####################################
```

FIGURE 3.64B

```
3.65 HHATL_GRB2
113TTAGGC_7    -chr3:42744071_-chr17:73328878      HHATL_GRB2        fusion_template
***************************************************************************************
CCAGAGCCTGAGGTGGCAGTGTGCCAGGTCCCTTGCGGCCTCCTCAAG|GTTTTGAACGAAGAATGTGATCAGAACTGGTACAAGGC
AGAGCTTAATGG  junction_-chr3_42744071_-chr17_73328878_NM_020707_NM_002086
**********************************************|*****************************************
             ---------------------------------TGCGGCCTCCTCAAG|GTTTTGAACGAAGAATGTGATCAGAACTGGTACAA---
             SEQUENCER02:113:A815WVABXX:7:1102:10914:153675
             ---------------------------------TGCGGCCTCCTCAAG|GTTTTGAACGAAGAATGTGATCAGAACTGGTACAA---
             SEQUENCER02:113:A815WVABXX:7:1201:19586:165476
```

```
------------------    ------AAGGGGGACATCCTCAAG|GTTTTGAACGAAGAATGTGACCAGAACTGGT------
----------------SEQUENCER02:113:A815WVABXX:7:1108:9861:146084
------------------    ------AAGGGGGACATCCTCAAG|GTTTTGAACGAAGAATGTGATCAGAACTGGT------
----------------SEQUENCER02:113:A815WVABXX:7:2202:15613:12207
------------------    ------AAGGGGGACATCCTCAAG|GTTTTGAACGAAGAATGTGATCAGAACTGGT------
----------------SEQUENCER02:113:A815WVABXX:7:2205:1450:41068
------------------    ------AAGGGGGACATCCTCAAG|GTTTTGAACGAAGAATGTGATCAGAACTGGT------
----------------SEQUENCER02:113:A815WVABXX:7:2207:9985:84081
------------------    -----AGGGGGGACATCCTCAAG|GTTTTGAACGAAGAATGTGATCAGAACTGGTA-----
----------------SEQUENCER02:113:A815WVABXX:7:1101:8075:60948
------------------    -----AGGGGGGACATCCTCAAG|GTTTTGAACGAAGAATGTGATCAGAACTGGTA-----
----------------SEQUENCER02:113:A815WVABXX:7:1204:6742:116324
------------------    -----AGGGGGGACATCCTCAAG|GTTTTGAACGAAGAATGTGATCAGAACTGGTA-----
----------------SEQUENCER02:113:A815WVABXX:7:1205:2289:34909
------------------    -----AGGGGGGACATCCTCAAG|GTTTTGAACGAAGAATGTGATCAGAACTGGTA-----
----------------SEQUENCER02:113:A815WVABXX:7:2203:2302:66921
------------------    -----AGGGGGGACATCCTCAAG|GTTTTGAACGAAGAATGTGATCAGAACTGGTA-----
----------------SEQUENCER02:113:A815WVABXX:7:2207:16608:8720
------------------    ----GGGGGGGACATCCTCAAG|GTTTTGAACGAAGAATGTGATCAGAACTGGTAC----
----------------SEQUENCER02:113:A815WVABXX:7:1102:8110:56974
------------------    ----GGGGGGGACATCCTCAAG|GTTTTGAACGAAGAATGTGATCAGAACTGGTACA---
----------------SEQUENCER02:113:A815WVABXX:7:1103:14546:192672
------------------    ----GGGGGGGACATCCTCAAG|GTTTTGAACGAAGAATGTGATCAGAACTGGTACA---
----------------SEQUENCER02:113:A815WVABXX:7:1104:18026:120931
------------------    ----GGGGGGGACATCCTCAAG|GTTTTGAACGAAGAATGTGATCAGAACTGGTAC----
----------------SEQUENCER02:113:A815WVABXX:7:1107:4160:190261
------------------    ----GGGGGGGACATCCTCAAG|GTTTTGAACGAAGAATGTGATCAGAACTGGTACA---
----------------SEQUENCER02:113:A815WVABXX:7:1205:4390:156214
------------------    ---GGGGGGGGACATCCTCAAG|GTTTTGAACGAAGAATGTGATCAGAACTGGTACA---
----------------SEQUENCER02:113:A815WVABXX:7:2107:17832:159431
------------------    ---GGGGGGGGACATCCTCAAG|GTTTTGAACGAAGAATGTGATCAGAACTGGTACA---
----------------SEQUENCER02:113:A815WVABXX:7:2108:15486:181787
```

FIGURE 3.65C

```
----------SEQUENCER02:113:A815WVABXX:7:2108:7945:133646----------GGGGGACATCCTCAAG|GTTTTGAACGAAGAATGTGATCAGAACTGGTACA---
----------SEQUENCER02:113:A815WVABXX:7:2201:17290:67444---------GGGGGACATCCTCAAG|GTTTTGAACGAAGAATGTGATCAGAACTGGTACA---
----------SEQUENCER02:113:A815WVABXX:7:2202:7024:17509----------GGGGGACATCCTCAAG|GTTTTGAACGAAGAATGTGATCAGAACTGGTAC----
----------SEQUENCER02:113:A815WVABXX:7:2203:17548:158427---------GGGGGACATCCTCAAG|GTTTTGAACGAAGAATGTGATCAGAACTGGTAC----
----------SEQUENCER02:113:A815WVABXX:7:2204:1121:63733-----------GGGGACATCCTCAAG|GTTTTGAACGAAGAATGTGATCAGAACTGGTACA---
----------SEQUENCER02:113:A815WVABXX:7:1104:15303:173698---------GGGGACATCCTCAAG|GTTTTGAACGAAGAATGTGATCAGAACTGGTACA---
----------SEQUENCER02:113:A815WVABXX:7:1104:18266:136103--------GGGGGACATCCTCAAG|GTTTTGAACGAAGAATGTGATCAGAACTGGTACA---
----------SEQUENCER02:113:A815WVABXX:7:1205:20988:129289--------GGGGGACATCCTCAAG|GTTTTGAACGAAGAATGTGATCAGAACTGGTACA---
----------SEQUENCER02:113:A815WVABXX:7:1206:12431:102498--------GGGGGACATCCTCAAG|GTTTTGAACGAAGAATGTGATCAGAACTGGTACA---
----------SEQUENCER02:113:A815WVABXX:7:1207:15696:73085---------GGGGGACATCCTCAAG|GTTTTGAACGAAGAATGTGATCAGAACTGGTACAA--
----------SEQUENCER02:113:A815WVABXX:7:1208:19277:32717---------GGGGGACATCCTCAAG|GTTTTGAACGAAGAATGTGATCAGAACTGGTACAA--
----------SEQUENCER02:113:A815WVABXX:7:2201:14554:12733---------GGGGGACATCCTCAAG|GTTTTGAACGAAGAATGTGATCAGAACTGGTACAA--
----------SEQUENCER02:113:A815WVABXX:7:2202:20661:34953---------GGGGACATCCTCAAG|GTTTTGAACGAAGAATGTGATCAGAACTGGTACAAG-
----------SEQUENCER02:113:A815WVABXX:7:1201:20967:174335---------GGGGACATCCTCAAG|GTTTTGAACGAAGAATGTGATCAGAACTGGTACAAG-
----------SEQUENCER02:113:A815WVABXX:7:1206:1473:150383---------GGGGGACATCCTCAAG|GTTTTGAACGAAGAATGTGATCAGAACTGGTACAAG-
----------SEQUENCER02:113:A815WVABXX:7:1206:6338:74439----------GGGGGACATCCTCAAG|GTTTTGAACGAAGAATGTGATCAGAACTGGTACAA--
```

FIGURE 3.65D

```
                                                  -------GGGACATCCTCAAG|GTTTTGAACGAAGAATGTGATCAGAACTGGTACAAG--
                     SEQUENCER02:113:A815WVABXX:7:2104:11265:191795
                     SEQUENCER02:113:A815WVABXX:7:2105:17944:39544
                     SEQUENCER02:113:A815WVABXX:7:2205:13563:166988
                     SEQUENCER02:113:A815WVABXX:7:2206:12770:104702
                     SEQUENCER02:113:A815WVABXX:7:2207:10174:29198
                     SEQUENCER02:113:A815WVABXX:7:2208:7930:42385
GACATCCTCAAG|GTTTTGAACGAAGAATGTGATCAGAACTGGTACAAGGC-------------
         SEQUENCER02:113:A815WVABXX:7:2105:13790:7393
########################################################################
113TTAGGC_7  -chr3:42744071 -chr17:73328878     HHATL_GRB2   donor_genomic_template
*********************************************************************
CCAGAGCCTGAGGTGGGCAGTGTGCCAGGTCCCCTGCGCCTCCTCAAG|GTCAGTGCCAGCTGGGATGCAGCTACTCTCGGGCTCT
TGAGACTTGTGG junction -chr3_42744071_NM_020707
########################################################################
113TTAGGC_7  -chr3:42744071 -chr17:73328878     HHATL_GRB2   acceptor_genomic_template
*********************************************************************
AAAGGGAAAAGGAAATGATTGGGTTTTTTTGTGTCTTATTCTTTTCAG|GTTTTGAACGAAGAATGTGATCAGAACTGGTACAAGC
AGAGCTTAATGG junction -chr17_73328878_NM_002086
########################################################################
```

FIGURE 3.65E

3.66 PPP2R2D_PANK1

```
114GCCAAT_4    +chr10:133761295_-chr10:91344222    PPP2R2D_PANK1   fusion template
****************************************************************************************
****************
AACGACTGCATCTTTGACAAGTTTGAGTGTTGCTGGAACGGTTCGGATAG|GGTTATTTTGGAGCCGTTGGGCACTGTTGGAACTGTT
CAAAATGACTGA   junction_+chr10_133761295_-chr10_91344222_NM_018461_NM_138316
-----------        GGAACGGTTCGGATAG|GGTTATTTTGGAGCCGTTGGGCACTGTTGGAAC---
           SEQUENCER02:114:B815WPABXX:4:1101:5982:124589
-----------        GGAACGGTTCGGATAG|GGTTATTTTGGAGCCGTTGGGCACTGTTGGAAC---
           SEQUENCER02:114:B815WPABXX:4:1103:18669:61458
-----------        GGAACGGTTCGGATAG|GGTTATTTTGGAGCCGTTGGGCACTGTTGGAAC---
           SEQUENCER02:114:B815WPABXX:4:1105:19867:33513
-----------        GGAACGGTTCGGATAG|GGTTATTTTGGAGCCGTTGGGCACTGTTGGAAC---
           SEQUENCER02:114:B815WPABXX:4:1105:7889:194381
-----------        GGAACGGTTCGGATAG|GGTTATTTTGGAGCCGTTGGGCACTGTTGGAAC---
           SEQUENCER02:114:B815WPABXX:4:1108:15931:162110
-----------        GGAACGGTTCGGATAG|GGTTATTTTGGAGCCGTTGGGCACTGTTGGAAC---
           SEQUENCER02:114:B815WPABXX:4:1108:4363:76446
-----------        GGAACGGTTCGGATAG|GGTTATTTTGGAGCCGTTGGGCACTGTTGGAAC---
           SEQUENCER02:114:B815WPABXX:4:1202:11014:172750
-----------        GGAACGGTTCGGATAG|GGTTATTTTGGAGCCGTTGGGCACTGTTGGAAC---
           SEQUENCER02:114:B815WPABXX:4:1208:20088:87524
-----------        GGAACGGTTCGGATAG|GGTTATTTTGGAGCCGTTGGGCACTGTGATGGAAC---
           SEQUENCER02:114:B815WPABXX:4:2108:9595:43286
-----------        GGAACGGTTCGGATAG|GGTTATTTTGGAGCCGTTGGGCACTGTTGGAAC---
           SEQUENCER02:114:B815WPABXX:4:2204:21176:179604
###################################################################################
################
114GCCAAT_4    +chr10:133761295_-chr10:91344222    PPP2R2D_PANK1   donor template
****************************************************************************************
****************
```

FIGURE 3.66A

```
AACGACTGCATCTTTGACAAGTTTGAGTGTTGCTGGAACGGTTCGGATAG|CGCCATCATGACGGGTCCTATAACAACTTCTTCAGGA
TGTTTGATAGAG  junction_+chr10_133761295_-chr10_133769188_NM_018461        PPP2R2D_PANK1  acceptor_template
###############################################################################################
114GCCAAT_4     +chr10:133761295_-chr10:133744222     PPP2R2D_PANK1   acceptor_template
****************************************************************************************
****************

TGGATTTTTGGTCCAAAGGACAACTGAAAGCTCTCTGTTTTTGGAACATGAG|GGTTATTTTGGAGCCGTTGGGGCACTGTTGGAACTGTT
CAAAATGACTGA  junction_-chr10_91348409_-chr10_91344222_NM_138316
###############################################################################################
114GCCAAT_4     +chr10:133761295_-chr10:91344222     PPP2R2D_PANK1   donor_genomic_template
****************************************************************************************
****************

AACGACTGCATCTTTGACAAGTTTGAGTGTTGCTGGAACGGTTCGGATAG|GTAAGGCCTGCGTGGAGATGAGCTGTCGCCCCAAGCTT
GCTGGTTTCCGA  junction_+chr10_133761295_NM_018461
###############################################################################################
114GCCAAT_4     +chr10:133761295_-chr10:91344222     PPP2R2D_PANK1
                   acceptor_genomic_template
****************************************************************************************
****************

TACATATTTGGCTAAGGTTCAGAGATCATCGTTTTGTATTGTTTTCGTAG|GGTTATTTTGGAGCCGTTGGGGCACTGTTGGAACTGTT
CAAAATGACTGA  junction_-chr10_91344222_NM_138316
###############################################################################################
```

FIGURE 3.66B

3.67 C10orf137_LOC100169752
```
114GCCAAT_5   +chr10:127411703_+chr10:127266780   C10orf137_LOC100169752
              fusion_template
****************************************************************************************
****************
```

FIGURE 3.67A

```
ACTTTATTGATTCAGTGGGAAATGATGTGGATGTTGTCTCTGACTCTGAA|GTGAGGAGAAGATGCTGTTCTGAGAGCTGCTGATAATA
CGTGGATCCAAA  junction_+chr10_127411703_+chr10_127266780_NM_015608_NR_023362
------GTGGGAAATGATGTGGATGTTGTCTCTGACTCTGAA|GTGAGGAGAAGAT----------------------------------
            SEQUENCER02:114:B815WPABXX:5:1201:18862:158859
------GTGGGAAATGATGTGGATGTTGTCTCTGACTCTGAA|GTGAGGAGAAGAT----------------------------------
            SEQUENCER02:114:B815WPABXX:5:2103:4772:58827
------GTGGGAAATGATGTGGATGTTGTCTCTGACTCTGAA|GTGAGGAGAAGAT----------------------------------
            SEQUENCER02:114:B815WPABXX:5:2202:5287:30860
---------GATGTTGTCTCTGACTCTGAA|GTGAGGAGAAGATGCTGTTCTGAGAGCT---------------------
            SEQUENCER02:114:B815WPABXX:5:1207:9959:170244
---------GGATGTTGTCTCTGACTCTGAA|GTGAGGAGAAGATGCTGTCCTGAGAGCT---------------------
            SEQUENCER02:114:B815WPABXX:5:2205:6319:47838
####################################################################################
114GCCAAT_5    +chr10:127411703_+chr10:127266780_C10orf137_LOC100169752_donor_template
******************************************************************************************
ACTTTATTGATTCAGTGGGAAATGATGTGGATGTTGTCTCTGACTCTGAA|AACATAAAAAACTCCTGAAAATTCCCTACAGCAAGTC
GCACGTGAGCAT   junction_+chr10_127411703_+chr10_127412380_NM_015608
-----GGGAAATGATGTGGATGTTGTCTCTGACTCTGAA|AACATAAAAAACTCC-----------------------------------
            SEQUENCER02:114:B815WPABXX:5:1203:13643:69842
-----GGGAAATGATGTGGATGTTGTCTCTGACTCTGAA|AACATAAAAAACTCC-----------------------------------
            SEQUENCER02:114:B815WPABXX:5:2205:3300:183210
####################################################################################
114GCCAAT_5    +chr10:127411703_+chr10:127266780_C10orf137_LOC100169752
                acceptor_template
******************************************************************************************
GTAAACTTCACATCCATCGGGAAGTTACCCTTTGGGATTACTGATGAAG|GTGAGGAGAAGATGCTGTTCTGAGAGCTGCTGATAATA
CGTGGATCCAAA  junction_+chr10_127264921_+chr10_127266780_NR_023362
####################################################################################
```

FIGURE 3.67B

```
114GCCAAT_5    +chr10:127411703_+chr10:127266780  C10orf137_LOC100169752
               donor_genomic_template
***********************************************************************
ACTTTATTGATTCAGTGGGAAATGATGTGGATGTTGTCTCTGAACTCTGAA|GTAAGTGTTATTTGTCGCTTAAGTAATTTGGAGGTG
TTTTGTGATAGG   junction_+chr10_127411703_NM_015608
              -----GATGTGGATGTTGTCTCTGAACTCTGAA|GTAAGTGTTATTTGTTGCTTAAT----------------------
        SEQUENCER02:114:B815WPABXX:5:1208:18556:86182
              -----GATGTGGATGTTGTCTCTGAACTCTGAA|GTAAGTGTTATTTGTTGCTTAAT----------------------
        SEQUENCER02:114:B815WPABXX:5:2108:7231:184546
##############################################################################
##############
114GCCAAT_5    +chr10:127411703_+chr10:127266780  C10orf137_LOC100169752
               acceptor_genomic_template
***********************************************************************
TGTGGGATGTGGGCCGATAACAGGGTTTTCTAAAAGCACTTCTGCTTCAG|GTGAGGAGAAGATGCTGTTCTGAGAGCTGCTGATAATA
CGTGGATCCAAA   junction_+chr10_127266780_NR_023362
              ################################################################################
##############
```

FIGURE 3.67C

3.68 LDLRAD3_ANK3
```
114GCCAAT_5    +chr11:36057799_-chr10:62039397    LDLRAD3_ANK3  fusion_template
***********************************************************************
GTGTGACGGGCTGCCTGACTGCTTCGACAAGAGTGATGAGAAGGAGTGCC|TCTGATGCCAATGCAAGTTACTTAAGAGCAGCTCGAGC
TGGACACCTTGA   junction_+chr11_36057799_-chr10_62039397_NM_174902_NM_020987
              -----GCCTGACTGCTTCGACAAGAGTGATGAGAAGGAGTGCC|TCTGATGCCAAT------------------------
        SEQUENCER02:114:B815WPABXX:5:2106:2518:183680
              -----GACTGCTTCGACAAGAGTGATGAGAAGGAGTGCC|TCTGATGCCAATGCAA---------------------
        SEQUENCER02:114:B815WPABXX:5:2206:2463:75645
```

FIGURE 3.68A

```
###########################################################################
###########
114GCCAAT_5      +chr11:36057799_-chr10:62039397     LDLRAD3_ANK3    donor_template
*************   ****************************************   ***********   **************
GTGTGACGGGCTGCCTGACTGCTTCGACAAGAGTGATGAGAAGGAGTGCC|CCAAGGCTAAGTCGAAATGTGGCCAACCTTCTTCCCC
TGTGCCAGCGGC     junction_+chr11_36057799_+chr11_36103203_NM_174902
###########################################################################
114GCCAAT_5      +chr11:36057799_-chr10:62039397     LDLRAD3_ANK3    acceptor_template
*************   ****************************************   ***********   **************
CTGAGAAAAAGGAAACACCGCAAACGGTCCCGGATCGGAAGAAAAAG|TCTGATGCCAATGCAAGTTACTTAAGAGCAGCTCGAGC
TGGACACCTTGA     junction_-chr10_62149183_-chr10_62039397_NM_020987
###########################################################################
114GCCAAT_5      +chr11:36057799_-chr10:62039397     LDLRAD3_ANK3    donor_genomic_template
*************   ****************************************   ***********   **************
GTGTGACGGGCTGCCTGACTGCTTCGACAAGAGTGATGAGAAGGAGTGCC|GTGAGTGGCCTGGCCCTTTGCTGCTGGGGTGGCAGC
CATCCTGGGGCA     junction_+chr11_36057799_NM_174902
###########################################################################
114GCCAAT_5      +chr11:36057799_-chr10:62039397     LDLRAD3_ANK3    acceptor_genomic_template
*************   ****************************************   ***********   **************
ATGCATATTAGCTTCATTTTTCATCAAAATGTGTTTCTTTTTTATTTTAG|TCTGATGCCAATGCAAGTTACTTAAGAGCAGCTCGAGC
TGGACACCTTGA     junction_-chr10_62039397_NM_020987
###########################################################################
```

FIGURE 3.68B

```
3.69 ZDHHC21_HMGB1

114GCCAAT_6    -chr9:14693227_-chr13:31037831        ZDHHC21_HMGB1_fusion_template
****************************************************************************************
TGCTGGCCGGTCGGGAGAGCGGCGGCAGCGAGAGGCGAGCCAGCGGCGACG|AAAAATAACTAAACATGGGCAAAGGAGATCCTAAGAAG
CCGAGAGGCAAA junction_-chr9_14693227_-chr13_31037831_-chr13_31037831_NM_178566_NM_002128
                        AGAGGCGAGCCAGCGGCGACG|AAAAATAACTAAACATGGGCAAAGGAGAT----------
    SEQUENCER02:114:B815WPABXX:6:1101:17871:190924
                        AGAGGCGAGCCAGCGGCGACG|AAAAATAACTAAACATGGGCAAAGGAGAT----------
    SEQUENCER02:114:B815WPABXX:6:1103:10770:122269
                        AGAGGCGAGCCAGCGGCGACG|AAAAATAACTAAACATGGGCAAAGGAGAT----------
    SEQUENCER02:114:B815WPABXX:6:1105:21131:105464
                        AGAGGCGAGCCAGCGGCGACG|AAAAATAACTAAACATGGGCAAAGGAGAT----------
    SEQUENCER02:114:B815WPABXX:6:1107:13995:150806
                        AGAGGCGAGCCAGCGGCGACG|AAAAATAACTAAACATGGGCAAAGGAGAT----------
    SEQUENCER02:114:B815WPABXX:6:1202:10985:63393
                        AGAGGCGAGCCAGCGGCGACG|AAAAATAACTAAACATGGGCAAAGGAGAT----------
    SEQUENCER02:114:B815WPABXX:6:2102:14477:16103
                        AGAGGCGAGCCAGCGGCGACG|AAAAATAACTAAACATGGGCAAAGGAGAT----------
    SEQUENCER02:114:B815WPABXX:6:2108:1341:43875
                        AGAGGCGAGCCAGCGGCGACG|AAAAATAACTAAACATGGGCAAAGGAGAT----------
    SEQUENCER02:114:B815WPABXX:6:2202:17188:85595
################################################################################################
################

114GCCAAT_6    -chr9:14693227_-chr13:31037831        ZDHHC21_HMGB1_donor_template
****************************************************************************************
TGCTGGCCGGTCGGGAGAGCGGCGGCAGCGAGAGGCGAGCCAGCGGCGACG|AATGAAGAACTTTTTCACTTACTGCAGGATTTTCAGCT
TCAGCAAGCAGG junction_-chr9_14693227_-chr9_14690383_NM_178566
****************************************************************************************
AGCGGGCGACG|AATGAAGAACTTTTTTACTTACTGCAGGATTTTCAGCTTC---------
    SEQUENCER02:114:B815WPABXX:6:1206:2650:181122
```

FIGURE 3.69A

```
AGCGGCGACG|AATGAAGAACTTTTTTACTTACTGCAGGATTTTCAGCTTC------------------
           SEQUENCER02:114:B815WPABXX:6:2103:7102:44578

AGCGGCGACG|AATGAAGAACTTTTTTACTTACTGCAGGATTTTCAGCTTC------------------
           SEQUENCER02:114:B815WPABXX:6:2105:3669:50942

AGCGGCGACG|AATGAAGAACTTTTTTACTTACTGCAGGATTTTCAGCTTC------------------
           SEQUENCER02:114:B815WPABXX:6:2205:2501:4012

AGCGGCGACG|AATGAAGAACTTTTTTACTTACTGCAGGATTTTCAGCTTC------------------
           SEQUENCER02:114:B815WPABXX:6:2205:4773:111868

AGCGGCGACG|AATGAAGAACTTTTTTACTTACTGCAGGATTTTCAGCTTC##################
           SEQUENCER02:114:B815WPABXX:6:2206:19031:116077
####################################################
114GCCAAT_6    -chr9:14693227_-chr13:31037831    ZDHHC21_HMGB1  acceptor_template
**************************************************************************
GGGCAAGTGAGAGCCGGACGGGCACTGGGCGACTCTGTGCCTCGCTGAGG|AAAAATAACTAAACATGGGCAAAGGAGATCCTAAGAAG
CCGAGAGGCAAA   junction_-chr13_31039933_-chr13_31037831_NM_002128 ###################
114GCCAAT_6    -chr9:14693227_-chr13:31037831    ZDHHC21_HMGB1  donor_genomic_template
**************************************************************************
TGCTGGCGGTCGGGAGAGCGGCGGCCAGCGGCGAGAGCCAGCGGCGACG|GTGAGTGTGCAGGCGGGGGCGAAGCGGCCGCCCCCA
CCCCCATCCCCA   junction_-chr9_14693227_NM_178566 ####################################
114GCCAAT_6    -chr9:14693227_-chr13:31037831    ZDHHC21_HMGB1
             acceptor_genomic_template
```

FIGURE 3.69B

```
***************************************************************************
**********
TATATGTCATAATTTTATTGCTAACATCAAATATTTATTTTATTTTTAG|AAAAATAACTAAACATGGCAAAGGAGATCCTAAGAAG
CCGAGAGGCAAA   junction_-chr13_31037831_NM_002128
##########################################################################
#########
```

FIGURE 3.69C

```
3.70 DNMBP_TACC2
114GCCAAT_7    -chr10:101769595_+chr10:123954555   DNMBP_TACC2     fusion_template
*************************************************************************
**********
CGGCTGCAACTGCCTGCCGCGCCGAGGACCGCCGGGCGGCGGAAAGCAG|GAGTTCCGATTCTGAAGAGGCATTTGAGACCCGGAGT
CAACGACCCCTG   junction_-chr10_101769595_+chr10_123954555_NM_015221_NM_006997
----------- ----CCGGGCGGCGGAAAGCAG|GAGTTCCGATTCTGAAGAGGCATTTGAGACCC------
----------- SEQUENCER02:114:B815WPABXX:7:1107:17999:38240
###########################################################################
#########
114GCCAAT_7    -chr10:101769595_+chr10:123954555   DNMBP_TACC2     donor_template
*************************************************************************
**********
CGGCTGCAACTGCCTGCCGCGCCGAGGACCGCCGGGCGGCGGAAAGCAG|GTTATAAAACATGGAGGCTGGCTCAGTGGTTCGAGCCA
TTTTTGACTTCT   junction_-chr10_101769595_-chr10_101731891_NM_015221
----------- ----CGGCGGAAAGCAG|GTTATAAAACATGGAGGCTGGCTCAGTGGTTCGAGCC-
----------- SEQUENCER02:114:B815WPABXX:7:1103:17296:181234
----------- ----CGGCGGAAAGCAG|GTTATAAAACATGGAGGCTGGCTCAGTGGTTCGAGCC-
----------- SEQUENCER02:114:B815WPABXX:7:1106:4653:86057
----------- ----CGGCGGAAAGCAG|GTTATAAAACATGGAGGCTGGCTCAGTGGTTCGAGCC-
----------- SEQUENCER02:114:B815WPABXX:7:1205:1746:151802
----------- ----CGGCGGAAAGCAG|GTTATAAAACATGGAGGCTGGCTCAGTGGTTCGAGCC-
----------- SEQUENCER02:114:B815WPABXX:7:2108:19309:101585
###########################################################################
#########
```

FIGURE 3.70A

```
114GCCAAT_7     -chr10:101769595 +chr10:123954555  DNMBP_TACC2   acceptor_template
****************************************************************************
CTGCAGCCAGCCCCAGCGACCTGAACCTGGAGGCTTCCGAGGCAAT|GAGTTCCGATTCTGAAGAGGCATTTGAGACCCCGGAGT
CAACGACCCCTG   junction +chr10_123923507 +chr10_123954555_NM_006997
################################################################################
114GCCAAT_7     -chr10:101769595 +chr10:123954555  DNMBP_TACC2   donor_genomic_template
****************************************************************************
CGGCTGCAACTGCCTGCCGGCCGCCTGAGGGACCGCCGGGGGCGGAAAGCAG|GTCAGAGGCCGGCCGGCCGGGGGCCG
GGCGGGGAGCGG   junction -chr10_101769595_NM_015221
################################################################################
114GCCAAT_7     -chr10:101769595 +chr10:123954555  DNMBP_TACC2
       acceptor_genomic_template
****************************************************************************
GAACTGGCTCTGGGCCCCTGTCTAACCTGTGCTTCTCCCTCTCTCATCAG|GAGTTCCGATTCTGAAGAGGCATTTGAGACCCCGGAGT
CAACGACCCCTG   junction +chr10_123954555_NM_006997
################################################################################
```

FIGURE 3.70B

3.71 SNX9_RAB2A

```
114TTAGGC_5     +chr6:158244478 +chr8:61531139   SNX9_RAB2A    fusion_template
****************************************************************************
GACGAGCCGGCCGTCCCGGGACCCGCCATGGCCACCAAG|GCATTATTAATACAGCAAAAGAAATTTATGAAAAAT
TCAAGAAGGAGT   junction +chr6_158244478 +chr8_61531139_NM_016224_NM_002865
----------CGCCCGCCATGGCCACCAAG|GCATTATTAATACAGCAAAAGAAATTT-------
       SEQUENCER02:114:B815WPABXX:5:1102:14428:176457
```

FIGURE 3.71A

```
##################################################################################
114TTAGGC_5      +chr6:158244478_+chr8:61531139     SNX9_RAB2A    donor_template
**********************************************************************************
GACGAGCCGGCCGTCCCGGGCCGGGGACCCGCCCGCCATGGCCACCAAG|GCTCGGGTTATGTATGATTTTGCTGCTGAACCTGGAAA
TAATGAACTGAC  junction_+chr6_158244478_+chr8_158288579_NM_016224
##################################################################################
114TTAGGC_5      +chr6:158244478_+chr8:61531139     SNX9_RAB2A    acceptor_template
**********************************************************************************
GACTCATCTTCATGGAAACGTCTGCTAAGACTGCTTCCAATGTAGAAGAG|GCATTTATTAATACAGCAAAAGAAATTTATGAAAAAAT
TCAAGAAGGAGT  junction_+chr8_61504528_+chr8_61531139_NM_002865
##################################################################################
114TTAGGC_5      +chr6:158244478_+chr8:61531139     SNX9_RAB2A    donor_genomic_template
**********************************************************************************
GACGAGCCGGCCGTCCCGGGCCGGGGACCCGCCCGCCATGGCCACCAAG|GTGAGGGGCGCGGCGCCGGCCCGGCGGCCCGGTCGCTCAG
GCCCGGGGCGGC  junction_+chr6_158244478_NM_016224
##################################################################################
114TTAGGC_5      +chr6:158244478_+chr8:61531139     SNX9_RAB2A    acceptor_genomic_template
**********************************************************************************
TTTTACTGCTTTGGTTTTATATAATATGAACCAATTTCTCTATATTTCAG|GCATTTATTAATACAGCAAAAGAAATTTATGAAAAAAT
TCAAGAAGGAGT  junction_+chr8_61531139_NM_002865
##################################################################################
```

FIGURE 3.71B

3.72 SLC19A2_NAA50

```
115GCCAAT_1         -chr1:169454801_-chr3:113442942        SLC19A2_NAA50  fusion_template
*****************************************************************************************
********************
TCCTGACCCCGTACCTGCTGGGCCGACAAGAACCTGACCGAGAGGGAG|TAGCCGGATCGAGCTGGGAGATGTGACCACACAATA
TTAAACAGTTGA   junction_-chr1_169454801_-chr3_113442942_NM_006996_NM_025146
-----------------------------------------------|--GGGGCCGGATCGAGCTGGGAGATGTGACCACACAATA
-----------------------------------------------|TAGCCGGATCGAGCTGGG--------------------
###############################################################################--------
       SEQUENCER02:115:A8164TABXX:1:1107:6053:133671
##############
115GCCAAT_1         -chr1:169454801_-chr3:113442942        SLC19A2_NAA50  donor_template
*****************************************************************************************
********************
TCCTGACCCCGTACCTGCTGGGCCGACAAGAACCTGACCGAGAGGGAG|GTCTTCAATGAAATTTATCCAGTATGGACTTACTCTTA
CCTGGTGCTACT   junction_-chr1_169454801_-chr1_169446995_NM_006996
----GCTGGGGCCGAACAAGAACCTGACCGAGAGGGAG|GTCTTCAATGAAATTT----------------------
       SEQUENCER02:115:A8164TABXX:1:1103:9380:190356
----GCTGGGGCCGAACAAGAACCTGACCGAGAGGGAG|GTCTTCAATGAAATTT----------------------
       SEQUENCER02:115:A8164TABXX:1:2108:16901:195219
------------GGGCCGGACAAGAACCTGACCGAGAGGGAG|GTCTTCAATGAAATTTATC------------------
       SEQUENCER02:115:A8164TABXX:1:1204:15784:187649
------------GGGCCGGACAAGAACCTGACCGAGAGGGAG|GTCTTCAATGAAATTTATCC-----------------
       SEQUENCER02:115:A8164TABXX:1:1202:7557:121785
------------GGGCCGGACAAGAACCTGACCGAGAGGGAG|GTCTTCAATGAAATTTATCC-----------------
       SEQUENCER02:115:A8164TABXX:1:1206:19661:15723
------------GGGCCGGACAAGAACCTGACCGAGAGGGAG|GTCTTCAATGAAATTTATCC-----------------
       SEQUENCER02:115:A8164TABXX:1:2204:4327:167048
------------GGGCCGGACAAGAACCTGACCGAGAGGGAG|GTCTTCAATGAAATTTATCC-----------------
       SEQUENCER02:115:A8164TABXX:1:2207:15608:173379
################################################################################
115GCCAAT_1         -chr1:169454801_-chr3:113442942        SLC19A2_NAA50  acceptor_template
```

FIGURE 3.72A

```
****************************************************************
**********
CGTTGATATCGGTGGTAACGACGGCCTCAGCAGGCGGGGAAGATGAAAGG|TAGCCGGATCGAGCTGGGAGATGTGACACCACAATA
TTAAACAGTTGA   junction_-chr3_113464789_-chr3_113442942_NM_025146
------------AGCAGGCGGGGAAGATGAAAGG|TAGCCGGATCGAGCTGGGAGTTGTGACA--------
            SEQUENCER02:115:A8164TABXX:1:2105:9645:24868
------------AGCAGGCGGGGAAGATGAAAGG|TAGCCGGATCGAGCTGGGAGATGTGACA--------
            SEQUENCER02:115:A8164TABXX:1:2105:9850:89177
-------------GCAGGCGGGGAAGATGAAAGG|TAGCCGGATCGAGCTGGGAGATGTGACA--------
            SEQUENCER02:115:A8164TABXX:1:2205:8097:54718
--------------CAGGCGGGGAAGATGAAAGG|TAGCCGGATCGAGCTGGGAGATGTGACACC------
            SEQUENCER02:115:A8164TABXX:1:1103:9198:184629
--------------CAGGCGGGGAAGATGAAAGG|TAGCCGGATCGAGCTGGGAGATGTGACACC------
            SEQUENCER02:115:A8164TABXX:1:1106:12416:63038
--------------CAGGCGGGGAAGATGAAAGG|TAGCCGGATCGAGCTGGGAGATGTGACACC------
            SEQUENCER02:115:A8164TABXX:1:1208:16004:70876
---------------GGCGGGGAAGATGAAAGG|TAGCCGGAATCGAGCTGGGAGATGTGACACCAC----
            SEQUENCER02:115:A8164TABXX:1:1105:9026:142868
---------------GGCGGGGAAGATGAAAGG|TAGCCGGATCGAGCTGGGAGATGTGACACCAC----
            SEQUENCER02:115:A8164TABXX:1:1108:3053:65861
----------------GCGGGGAAGATGAAAGG|TAGCCGGATCGAGCTGGGAGATGTGACACCACA---
            SEQUENCER02:115:A8164TABXX:1:1106:3367:168822
----------------GCGGGGAAGATGAAAGG|TAGCCGGATCGAGCTGGGAGATGTGACACCACA---
            SEQUENCER02:115:A8164TABXX:1:2202:12130:99197
-----------------GGGGAAGATGAAAGG|TAGCCGGATCGAGCTGGGAGATGTGACACCACACA--
            SEQUENCER02:115:A8164TABXX:1:1103:6694:118098
-----------------GGGGAAGATGAAAGG|TAGCCGGATCGAGCTGGGAGATGTGACACCACACA--
            SEQUENCER02:115:A8164TABXX:1:1203:10796:87971
-----------------GGGGAAGATGAAAGG|TAGCCGGATCGAGCTGGGAGATGTGACACCACACA--
            SEQUENCER02:115:A8164TABXX:1:1204:9789:46094
-----------------GGGGAAGATGAAAGG|TAGCCGGATCGAGCTGGGAGATGTGACACCACAC---
            SEQUENCER02:115:A8164TABXX:1:1205:8892:194080
```

```
----                                                                                            ----
CGAGTGGG|CTAAACCATTTACACAGCTGGTGAAAGAAATGCAGCTTCATC----
SEQUENCER02:115:A8164TABXX:1:1104:3861:33803
----                                                                                            ----
CGAGTGGG|CTAAACCATTTACACAGCTGGTGAAAGAAATGCAGCTTCATC----
SEQUENCER02:115:A8164TABXX:1:1207:9081:129159
----                                                                                            ----
GAGTGGG|CTAAACCATTTACACAGCTGGTGAAAGAAATGCAGCTTCATCG----
SEQUENCER02:115:A8164TABXX:1:1101:7438:6935
----                                                                                            ----
GAGTGGG|CTAAACCATTTACACAGCTGGTGAAAGAAATGCAGCTTCATCG----
SEQUENCER02:115:A8164TABXX:1:1105:15895:161518
----                                                                                            ----
GAGTGGG|CTAAACCATTTACACAGCTGGTGAAAGAAATGCAGCTTCATCG----
SEQUENCER02:115:A8164TABXX:1:1106:14129:131340
----                                                                                            ----
GAGTGGG|CTAAACCATTTACACAGCTGGTGAAAGAAATGCAGCTTCATCG----
SEQUENCER02:115:A8164TABXX:1:2106:17459:94931
----                                                                                            ----
GAGTGGG|CTAAACCATTTACACAGCTGGTGAAAGAAATGCAGCTTCATCG----
SEQUENCER02:115:A8164TABXX:1:2202:13402:70879
----                                                                                            ----
GAGTGGG|CTAAACCATTTACACAGCTGGTGAAAGAAATGCAGCTTCATCG----
SEQUENCER02:115:A8164TABXX:1:2208:4341:86767
----                                                                                            ----
AGTGGG|CTAAACCATTTACACAGCTGGTGAAAGAAATGCAGCTTCATCGA----
SEQUENCER02:115:A8164TABXX:1:1207:7056:53740
----                                                                                            ----
AGTGGG|CTAAACCATTTACACAGCTGGTGAAAGAAATGCAGCTTCATCGA----
SEQUENCER02:115:A8164TABXX:1:2102:6482:100570
----                                                                                            ----
AGTGGG|CTAAACCATTTACACAGCTGGTGAAAGAAATGCAGCTTCATCGA----
SEQUENCER02:115:A8164TABXX:1:2105:19908:108299
```

FIGURE 3.73B

```
AGTGGG|CTAAACCATTTACACAGCTGGTGAAAGAAATGCAGCTTCATCGA------|
          SEQUENCER02:115:A8164TABXX:1:2106:13209:41378

AGTGGG|CTAAACCATTTACACAGCTGGTGAAAGAAATGCAGCTTCATCGA------|
          SEQUENCER02:115:A8164TABXX:1:2107:3665:180772

AGTGGG|CTAAACCATTTACACAGCTGGTGAAAGAAATGCAGCTTCATCGA------|
          SEQUENCER02:115:A8164TABXX:1:2205:16109:190853

AGTGGG|CTAAACCATTTACACAGCTGGTGAAAGAAATGCAGCTTCATCG-------|
          SEQUENCER02:115:A8164TABXX:1:2206:20190:192214

AGTGGG|CTAAACCATTTACACAGCTGGTGAAAGAAATGCAGCTTCATCGA------|
          SEQUENCER02:115:A8164TABXX:1:2207:12505:42852

##############################################################################
115GCCAAT_1     -chr14:103523336_-chr4:152594048    CDC42BPB_PET112    acceptor_template
****************************************************************************
TTCTTGACCTGCTGGACAGCAGAACAATTTCTTCATCAGCAGCTAAACAG|GTGTTTGAGGAACTGTGGAAGAGGGAAGGCAAGACTCC
AGGGCAGATTGT  junction_-chr4_152600965_-chr4_152594048_NM_004564
#############################################################################
115GCCAAT_1     -chr14:103523336_-chr4:152594048    CDC42BPB_PET112
*****************************************************************************
                donor_genomic_template
****************
CCACTCGGCCCTGCGCGCCGACAAGTACGTGGCCGAGTTCCTCGAGTGGG|GTAAGTGCGCGCCGGACCTGCGGCTCTGC
GACCCCGCGCC  junction_-chr14_103523336_NM_006035
##############################################################################

FIGURE 3.73C
```

```
115GCCAAT_1       -chr14:103523336_-chr4:152594048    CDC42BPB_PET112    acceptor_genomic_template
***********************************************************************************************
AGAAGAGCTGACTTCCTCATTTCTCTTTCCTCCCTTCTCTGGTCCATAG|GTGTTTGAGGAACTGTGGAAGAGGAAGGCAAGACTCC
AGGGCAGATTGT   junction -chr4_152594048_NM_004564
##########################################################################################
##############
```

FIGURE 3.73D

3.74 NAT1_DDHD2

```
115GCCAAT_3   +chr8:18067689_+chr8:38099768  NAT1_DDHD2     fusion_template
*************************************************************************
TGGGAGGATTGCATTCAGTCTAGTTCCTGGTTGCCGGCTGAAATAACCTG|TTAATGATTTTCGCAGTGTTTCCTTGAACTTGCTACAG
ACACATTTTAAG  junction +chr8_18067689_+chr8_38099768_NAT1_DDHD2|AATTCAAGCCAGGAAGAGCAGCAATCTGTCTTCTGGA
#####################################################################################
##############
           SEQUENCER02:115:A8164TABXX:3:1106:18960:187044
115GCCAAT_3   +chr8:18067689_+chr8:38099768  NAT1_DDHD2     donor_template
*************************************************************************
TGGGAGGATTGCATTCAGTCTAGTTCCTGGTTGCCGGCTGAAATAACCTG|AATTCAAGCCAGGAAGAGCAGCAATCTGTCTTCTGGA
TTAAAACTGAAG  junction +chr8_18067689_+chr8_18076920_NM_000662
           ----------TTCCTGGTTGCCGGCTGAAATAACCTG|AATTCAAGCCAGGATGAAGCAGC------------
           SEQUENCER02:115:A8164TABXX:3:1208:2201:31671
           ----------TTCCTGGTTGCCGGCTGAAATAACCTG|AATTCAAGCCAGGATGAAGCAGC------------
           SEQUENCER02:115:A8164TABXX:3:2102:14716:93617
           ----------TTCCTGGTTGCCGGCTGAAATAACCTG|AATTCAAGCCAGGATGAAGCAGC------------
           SEQUENCER02:115:A8164TABXX:3:2207:1993:46157
           ----------GGTTGCCGGCTGAAATAACCTG|AATTCAAGCCAGGAAGAAGCAGCAATCT------------
           SEQUENCER02:115:A8164TABXX:3:1101:19834:35320
```

FIGURE 3.74A

```
------------ SEQUENCER02:115:A8164TABXX:3:1104:12072:77549  ---GGTTGCCCGGCTGAAATAACCTG|AATTCAAGCCAGGAAGAAGCAGCAATCT-------
------------ SEQUENCER02:115:A8164TABXX:3:1202:20408:162358 ---GGTTGCCCGGCTGAAATAACCTG|AATTCAAGCCAGGAAGAAGCAGCAATCT-------
------------ SEQUENCER02:115:A8164TABXX:3:1208:17062:167625 ---GGTTGCCCGGCTGAAATAACCTG|AATTCAAGCCAGGAAGAAGCAGCAATCT-------
------------ SEQUENCER02:115:A8164TABXX:3:2101:19296:106570 ---GGTTGCCCGGCTGAAATAACCTG|AATTCAAGCCAGGAAGAAGCAGCAATCT-------
------------ SEQUENCER02:115:A8164TABXX:3:2106:13814:108569 ---GGTTGCCCGGCTGAAATAACCTG|AATTCAAGCCAGGAAGAAGCAGCAATCT-------
------------ SEQUENCER02:115:A8164TABXX:3:2107:16901:21873  ---GGTTGCCCGGCTGAAATAACCTG|AATTCAAGCCAGGAAGAAGCAGCAATCT-------
------------ SEQUENCER02:115:A8164TABXX:3:2203:20166:184320 ---GGTTGCCCGGCTGAAATAACCTG|AATTCAAGCCAGGAAGAAGCAGCAATCT-------
------------ SEQUENCER02:115:A8164TABXX:3:2205:9416:134446  ---GGTTGCCCGGCTGAAATAACCTG|AATTCAAGCCAGGAAGAAGCAGCAATCT-------
------------ SEQUENCER02:115:A8164TABXX:3:2206:17006:173359 ---GGTTGCCCGGCTGAAATAACCTG|AATTCAAGCCAGGAAGAAGCAGCAATCT-------
------------ SEQUENCER02:115:A8164TABXX:3:2207:10937:41139  ---GTTGCCCGGCTGAAATAACCTG|AATTCAAGCCAGGAAGAAGCAGCAATCT-------
------------ SEQUENCER02:115:A8164TABXX:3:1104:11797:87635  ---GTTGCCCGGCTGAAATAACCTG|AATTCAAGCCAGGAAGAAGCAGCAATCT-------
------------ SEQUENCER02:115:A8164TABXX:3:1104:16564:195939 ---GTTGCCCGGCTGAAATAACCTG|AATTCAAGCCAGGAAGAAGCAGCAATCTG------
------------ SEQUENCER02:115:A8164TABXX:3:1105:6759:6718    ---GTTGCCCGGCTGAAATAACCTG|AATTCAAGCCAGGAAGAAGCAGCAATCT-------
------------ SEQUENCER02:115:A8164TABXX:3:1201:17268:163593 ---GTTGCCCGGCTGAAATAACCTG|AATTCAAGCCAGGAAGAAGCAGCAATCT-------
------------ SEQUENCER02:115:A8164TABXX:3:1202:13257:89952  ---GTTGCCCGGCTGAAATAACCTG|AATTCAAGCCAGGAAGAAGCAGCAATCT-------
------------ SEQUENCER02:115:A8164TABXX:3:1203:13890:194592 ---GTTGCCCGGCTGAAATAACCTG|AATTCAAGCCAGGAAGAAGCAGCAATCT-------
```

FIGURE 3.74B

```
-----------------------------GTTGCCGGCTGAAATAACCTG|AATTCAAGCCAGGAAGAAGCAGCAATCTG-----
       SEQUENCER02:115:A8164TABXX:3:1203:20980:108341
-----------------------------GTTGCCGGCTGAAATAACCTG|AATTCAAGCCAGGAAGAAGCAGCAATCT------
       SEQUENCER02:115:A8164TABXX:3:1206:6749:192881
-----------------------------GTTGCCGGCTGAAATAACCTG|AATTCAAGCCAGGAAGAAGCAGCAATCT------
       SEQUENCER02:115:A8164TABXX:3:2102:5719:115399
-----------------------------GTTGCCGGCTGAAATAACCTG|AATTCAAGCCAGGAAGAAGCAGCAATCT------
       SEQUENCER02:115:A8164TABXX:3:2103:11514:21154
-----------------------------GTTGCCGGCTGAAATAACCTG|AATTCAAGCCAGGAAGAAGCAGCAATCT------
       SEQUENCER02:115:A8164TABXX:3:2205:11419:29438
-----------------------------GTTGCCGGCTGAAATAACCTG|AATTCAAGCCAGGAAGAAGCAGCAATCT------
       SEQUENCER02:115:A8164TABXX:3:1105:20232:149254
-----------------------------TGCCGGCTGAAATAACCTG|AATTCGAGCCAGGAAGAAGCAGCAATCTGTC----
       SEQUENCER02:115:A8164TABXX:3:2208:14956:108467
-----------------------------TGCCGGCTGAAATAACCTG|AATTCGAGCCAGGAAGAAGCAGCAATCTGTC----
       SEQUENCER02:115:A8164TABXX:3:2104:1941:25158
-----------------------------TGCCGGCTGAAATAACCTG|AATTCAAGCCAGGAAGAAGCAGCAATCTGTC----
       SEQUENCER02:115:A8164TABXX:3:2203:17805:81008
-----------------------------TGCCGGCTGAAATAACCTG|AATTCAAGCCAGGAAGAAGCAGCAATCTGTC----
       SEQUENCER02:115:A8164TABXX:3:2208:5165:21247
-----------------------------GCCGGCTGAAATAACCTG|AATTCAAGCCAGGAAGAAGCAGCAATCTGTCT----
       SEQUENCER02:115:A8164TABXX:3:1204:6401:19065
GAAATAACCTG|AATTCAAGCCAGGAAGAAGCAGCAATCTGTCTTCTGGAT--------------------------------
       SEQUENCER02:115:A8164TABXX:3:1107:6472:117998
GAAATAACCTG|AATTCAAGCCAGGAAGAAGCAGCAATCTGTCTTCTGGAT--------------------------------
       SEQUENCER02:115:A8164TABXX:3:1202:9810:148505
GAAATAACCTG|AATTCAAGCCAGGAAGAAGCAGCAATCTGTCTTCTGGAT--------------------------------
       SEQUENCER02:115:A8164TABXX:3:1206:4265:99535
```

FIGURE 3.74C

```
---------------------------------------
GAAATAACCTG|AATTCAAGCCAGGAAGAAGCAGCAATCTGTCTTCTGGAT-----------
  SEQUENCER02:115:A8164TABXX:3:2104:18825:142058
---------------------------------------
GAAATAACCTG|AATTCAAGCCAGGAAGAAGCAGCAATCTGTCTTCTGGAT-----------
  SEQUENCER02:115:A8164TABXX:3:2104:1996:158003
##############################################################
########
115GCCAAT_3    +chr8:18067689_+chr8:38099768 NAT1_DDHD2    acceptor_template
**************************************************************
*************
TGGGATTGGACCAGCTTGTGATCTCCGCTTTCGAAGCATTGTACAGTGTG|TTAATGATTTTCGCAGTGTTTCCTTGAACTTGCTACAG
ACACATTTTAAG    junction_+chr8_38097882_+chr8_38099768_NM_015214
##############################################################
########
115GCCAAT_3    +chr8:18067689_+chr8:38099768 NAT1_DDHD2    donor_genomic_template
*************************************************
*************
TGGGAGGATTGCATTCAGTCTAGTTCCTGGTTGCCGGCTGAAATAACCTG|GTAAGTGGAACTCTGTAAGGGCTTTGAAATTGGGGTT------
TAATCCTATCTC    junction_+chr8_18067689_NM_000662
                -----CCTGGTTGCCGGCTGAAATAACCTG|GTAAGTGGAACTCTGTAAGGGCTT---------
                  SEQUENCER02:115:A8164TABXX:3:1102:20191:29838
                -----CCTGGTTGCCGGCTGAAATAACCTG|GTAAGTGGAACTCTGTAAGGGCTT---------
                  SEQUENCER02:115:A8164TABXX:3:1103:16113:2519
                -----CCTGGTTGCCGGCTGAAATAACCTG|GTAAGTGGAACTCTGTAAGGGCTT---------
                  SEQUENCER02:115:A8164TABXX:3:1202:18024:194564
                -----CCTGGTTGCCGGCTGAAATAACCTG|GTAAGTGGAACTCTGTAAGGGCTT---------
                  SEQUENCER02:115:A8164TABXX:3:2108:21128:100005
                -----CCGGCTGAAATAACCTG|GTAAGTGGAACTCTGTAAGGGCTTTGAAATT-----
                  SEQUENCER02:115:A8164TABXX:3:1102:17695:90208
                -----CCGGCTGAAATAACCTG|GTAAGTGGAACTCTGTAAGGGCTTTGAAATT-----
                  SEQUENCER02:115:A8164TABXX:3:1201:5344:43598
```

FIGURE 3.74D

```
###############################################################################
#############
115GCCAAT_3    +chr8:18067689_+chr8:38099768_NAT1_DDHD2    acceptor_genomic_template
************   *********************************************************************
TACAGATTTGTTACTTCATTGTTGATGCATAAGTTAATTTTCTTTTCCAG|TTAATGATTTTCGCAGTGTTTCCTTGAACTTGCTACAG
ACACATTTTAAG   junction_+chr8_38099768_NM_015214
######   ################################################################
##########
```

FIGURE 3.74E

3.75 LOC729852_GLCCI1

```
115GCCAAT_5   +chr7:7841374_+chr7:8043538    LOC729852_GLCCI1    fusion_template
***********   *******************************************************************
TGACAGCAAGAGCAAAACTTCGGACATAGAGGCCAACCAACCTTTGGAG|CGGACAAGGCAAAATCTCAGCAAGTTCGGACCTCTAGT
ACAATAAGGCGA  junction_+chr7_7841374_+chr7_8043538_NR_034084_NM_138426
------------  --CAACCAACCTTTGGAG|CGGACAAGGCAAAATCTCAGCAAGTTCGGACCTC---
              SEQUENCER02:115:A8164TABXX:5:1206:13022:176181
######  ################################################################
***********

115GCCAAT_5   +chr7:7841374_+chr7:8043538    LOC729852_GLCCI1    donor_template
***********   *******************************************************************
TGACAGCAAGAGCAAAACTTCGGACATAGAGGCCAACCAACCTTTGGAG|ACCAACAAGAAAATTCATCCAGTGTGACTGTATCAGA
CCCTGAGATGGA  junction_+chr7_7841374_+chr7_7916912_NR_034084
######  ################################################################
***********

115GCCAAT_5   +chr7:7841374_+chr7:8043538    LOC729852_GLCCI1    acceptor_template
***********   *******************************************************************
GAGGAGCAGCTCACCTGAGAGACGGAGCCCCGGCTGCCCGTGTGCAGAG|CGGACAAGGCAAAATCTCAGCAAGTTCGGACCTCTAGT
ACAATAAGGCGA  junction_+chr7_8009438_+chr7_8043538_NM_138426
```

FIGURE 3.75A

```
115GCCAAT_5    +chr7:7841374_+chr7:8043538    LOC729852_GLCCI1    donor_genomic_template
***************    **********************    *****************    ***********************

TGACAGCAAGAGAGGCAAAACTTCGACATAGAGGCCAACCTTTGGAG|GTAAGTGAAACAGAGTAAGTCCTTTTCGGTGAAACTGA
ACAAGTCACTAT    junction_+chr7_7841374_NR_034084
#########    ###############################################

115GCCAAT_5    +chr7:7841374_+chr7:8043538    LOC729852_GLCCI1
                acceptor_genomic_template
****************    ************************    *****************

AAATTTTATTTATTTATTCACTAATGACTAAATCTTTTTTTTCACTTTCTGTAG|CGGACAAGGCAAAATCTCAGCAAGTTCGGACCTCTAGT
ACAATAAGGCGA    junction_+chr7_8043538_NM_138426
#########    ################################
```

FIGURE 3.75B

3.76 ZEB1_PLEKHF2

```
115GCCAAT_7    +chr10:31608221_+chr8:96166259    ZEB1_PLEKHF2    fusion_template
***************    **************************    ************    ***************

TGGCCCCAGTGTAAGCGCAGAAGCAGGCGAACCCGCGGGCGCAATAACG|GCTATTAGTGAAAGATGGTGGATCGCTTGGCAAACAGT
GAAGCAAATACT    junction_+chr10_31608221_+chr8_96166259_NM_030751_NM_024613
**************    *************************************************    ************
-----------AGCAGGCGAACCCGCGGGCGCAATAACG|GCTATTAGGGAAAGATGGTGGAT-----------
         SEQUENCER02:115:A8164TABXX:7:2107:20283:149511
         --------AGGCGAACCCGCGGGCGCAATAACG|GCTATTAGTGAAAGATGGTGGAT-----------
         SEQUENCER02:115:A8164TABXX:7:1106:13029:46833
#########    ##############################################

115GCCAAT_7    +chr10:31608221_+chr8:96166259    ZEB1_PLEKHF2    donor_template
```

FIGURE 3.76A

```
************************************************************
**********
TGGCCCCAGGTGTAAGCGCAGAAAGCAGGCGAACCCGCGGCGCAATAACG|TTACAAATTATAATACTGTGTAGAAACAAATTCAGAT
TCAGATGATGAA    junction_+chr10_31608221_+chr10_31749966_NM_030751
------------------GCAGGCGAACCCGCGGCGCAATAACG|TTACAAATTATAATACTGTGTAG-------
              SEQUENCER02:115:A8164TABXX:7:1105:17230:150186
----------------CAGGCGAACCCGCGGCGCAATAACG|TTACAAATTATAATACAGTGTAGA------
              SEQUENCER02:115:A8164TABXX:7:2103:18920:182986
---------------------CGCGGCGCAATAACG|TTACAAATTATAATACTGTGTAGAAACAAATTCA--
              SEQUENCER02:115:A8164TABXX:7:1104:10964:128272
---------------------CGCGGCGCAATAACG|TTACAAATTATAATACTGTGTAGAAACAAATTCA--
              SEQUENCER02:115:A8164TABXX:7:1107:3190:144822
--------------------CGCGGCGCAATAACG|TTACAAACTATAATACTGTGTAGAAACAAATTCA--
              SEQUENCER02:115:A8164TABXX:7:2101:12567:130054
----------------------GCGGCGCAATAACG|TTACAAATTATAATACTGTGTAGAAACAAATTCAG-
              SEQUENCER02:115:A8164TABXX:7:2106:17716:105732
-----------------------CGGCGCAATAACG|TTACAAATTATAATACTGTGTAGAAACAAATTCAG-
              SEQUENCER02:115:A8164TABXX:7:2201:5002:42770
############################################################
########
############################################################
**********
115GCCAAT_7   +chr10:31608221_+chr8:96166259   ZEB1_PLEKHF2   acceptor_template
**************************************************----------
TCGGACCTTCGCCTTCGCTGTCGCCGCCGCCGCCGCCCGCGCCGTCGGG|GCTATTAGTGAAAGATGGTGGATCGCTTGGCAAACAGT
GAAGCAAATACT    junction_+chr8_96146258_+chr8_96166259_NM_024613
############################################################
##########--------------########################################
115GCCAAT_7   +chr10:31608221_+chr8:96166259   ZEB1_PLEKHF2   donor_genomic_template
**********--------------************************************
TGGCCCCAGGTGTAAGCGCAGAAAGCAGGCGAACCCGCGGCGCAATAACG|GTGAGTGGCGGAGGGGACCGGGGAGCGGCGGAGTCAGG
GGGAGCTGGGCA    junction_+chr10_31608221_NM_030751
**********
```

FIGURE 3.76B

```
###########################################################################
###########
115GCCAAT_7    +chr10:31608221_+chr8:96166259     ZEB1_PLEKHF2
           acceptor_genomic_template
****************************************************************************
TAGGAATTTATAATTTATATGTGCTAATTTCTTTTCTTTTTTTAAAAG|GCTATTAGTGAAGATGTGGATCGCTTGGCAAACAGT
GAAGCAAATACT    junction_+chr8_96166259_NM_024613
###########################################################################
###########
```

FIGURE 3.76C

```
3.77 STAU1_TOP1
115TTAGGC_1   -chr20:47790732_+chr20:39690034   STAU1_TOP1    fusion_template
****************************************************
GAACTGAACAAGACAACATTGTTCCTGGAACGCCCCTCTTTTTAAAAAAG|ATTCTCATAAACACAAAGATAAACACAAAGATGAGAA
CACCGGCACACAA   junction -chr20_47790732_+chr20_39690034 STAU1_TOP1 fusion template
****************************************************
        ----ACATTGTTCCTGGAACGCCCCTCTTTTTAAAAAAG|ATTCTCATAAACACAAAGATAAACACAAAGATAAACACAAAGATAAACACAAAGATAAA-----
        SEQUENCER02:115:A8164TABXX:1:1204:16496:98170
        -----ACATTGTTCCTGGAACGCCCCTCTTTTTAAAAAAG|ATTCTCATAAGCACAA-------
        SEQUENCER02:115:A8164TABXX:1:1206:13928:11588
        -----ACATTGTTCCTGGAACGCCCCTCTTTTTAAAAAAG|ATTCTCATAAGCACAA-------
        SEQUENCER02:115:A8164TABXX:1:1206:20190:38740
        -----ACATTGTTCCTGGAACGCCCCTCTTTTTAAAAAAG|ATTCTCATAAGCACAA-------
        SEQUENCER02:115:A8164TABXX:1:2107:6167:94892
        -----ACATTGTTCCTGGAACGCCCCTCTTTTTAAAAAAG|ATTCTCATAAGCACAA-------
        SEQUENCER02:115:A8164TABXX:1:2202:4498:180316
        -----ACATTGTTCCTGGAACGCCCCTCTTTTTAAAAAAG|ATTCTCATAAGCACAA-------
        SEQUENCER02:115:A8164TABXX:1:2207:2879:196334
        -------TGGAACGCCCCTCTTTTTAAAAAAG|ATTCTCATAAACACAAAGATAAA-------
        SEQUENCER02:115:A8164TABXX:1:1102:3133:122203
```

FIGURE 3.77A

```
                                                                                            -------TGGAACGCCCTCTTTTTAAAAAAG|ATTCTCATAAACACAAAGATAAA------------------
                                                                                SEQUENCER02:115:A8164TABXX:1:1108:15202:13510
                                                                                            -------TGGAACGCCCTCTTTTTAAAAAAG|ATTCTCATAAACACAAAGATAAA------------------
                                                                                SEQUENCER02:115:A8164TABXX:1:1203:17908:54990
                                                                                            -------TGGAACGCCCTCTTTTTAAAAAAG|ATTCTCATAAACACAAAGATAAA------------------
                                                                                SEQUENCER02:115:A8164TABXX:1:1207:11631:156606
                                                                                            -------TGGAACGCCCTCTTTTTAAAAAAG|ATTCTCATAAACACAAAGATAAA------------------
                                                                                SEQUENCER02:115:A8164TABXX:1:2105:2076:11428
                                                                                            -------TGGAACGCCCTCTTTTTAAAAAAG|ATTCTCATAAACACAAAGATAAA------------------
                                                                                SEQUENCER02:115:A8164TABXX:1:2107:3153:12251
                                                                                            -------TGGAACGCCCTCTTTTTAAAAAAG|ATTCTCATAAACACAAAGATAAA------------------
                                                                                SEQUENCER02:115:A8164TABXX:1:2108:2735:42190
                                                                                            -------TGGAACGCCCTCTTTTTAAAAAAG|ATTCTCATAAACACAAAGATAAA------------------
                                                                                SEQUENCER02:115:A8164TABXX:1:2205:13015:55077
                                                                                            -------TGGAACGCCCTCTTTTTAAAAAAG|ATTCTCATAAACACAAAGATAAA------------------
                                                                                SEQUENCER02:115:A8164TABXX:1:2208:9350:147171
###############################################################################################################################
115TTAGGC_1    -chr20:47790732_+chr20:39690034    STAU1_TOP1    donor_template
**************************************************************************************************************************
GAACTGAACAAAGACAACAATTGTTCCTGGAACGCCCTCTTTTTAAAAAAG|AAAGCATAACCCCTACTGTAGAACTAAATGCACTGTGC
ATGAAACTTGGA   junction_-chr20_47790732_-chr20_47770608_NM_004602
                                                                                             ------GGAACGCCCTCTTTTTAAAAAAG|AAAGCATAACCCCTACTGTAGAAC-------------------
                                                                                SEQUENCER02:115:A8164TABXX:1:1102:8017:127480
                                                                                             ------GGAACGCCCTCTTTTTAAAAAAG|AAAGCATAACCCCTACTGTAGAAC-------------------
                                                                                SEQUENCER02:115:A8164TABXX:1:1202:16969:25175
###############################################################################################################################
115TTAGGC_1    -chr20:47790732_+chr20:39690034    STAU1_TOP1    acceptor_template
**************************************************************************************************************************
```

FIGURE 3.77B

```
GGACCACCTCCACAACGATTCCCAGATCGAAGCGGATTCCGATTGAATG|ATTCTCATAAACACAAAGATAAACACAAAGATCGAGAA
CACCGGCACAAA   junction +chr20_39658095 +chr20_39690034_NM_003286
###############################################################################
115TTTAGGC_1   -chr20:477790732 +chr20:39690034   STAU1_TOP1   donor_genomic_template
*******************************************************************************

GAACTGAACAACAAAGACAACATTGTTCCTGGAACGCCCTCTTTTAAAAAAG|GTACATATAAATTTGGCTTTATAATTTCTGGCCTGTTGA
TAATCAGTGGTA   junction_-chr20_47790732_NM_004602
            ---GGAACGCCCTCTTTTAAAAAAG|GTACATATAAATTTGGCTTTATAATTTC------
            SEQUENCER02:115:A8164TABXX:1:1101:12818:131568
            ---GGAACGCCCTCTTTTAAAAAAG|GTACATATAAATTTGGCTTTATAATTTC------
            SEQUENCER02:115:A8164TABXX:1:1104:21049:82350
            ---GGAACGCCCTCTTTTAAAAAAG|GTACATATAAATTTGGCTTTATAATTTC------
            SEQUENCER02:115:A8164TABXX:1:1106:11384:191326
            ---GGAACGCCCTCTTTTAAAAAAG|GTACATATAAATTTGGCTTTATAATTTC------
            SEQUENCER02:115:A8164TABXX:1:1205:13424:64067
            ---GGAACGCCCTCTTTTAAAAAAG|GTACATATAAATTTGGCTTTATAATTTC------
            SEQUENCER02:115:A8164TABXX:1:1206:13876:91810
            ---GGAACGCCCTCTTTTAAAAAAG|GTACATATAAATTTGGCTTTATAATTTC------
            SEQUENCER02:115:A8164TABXX:1:2103:18683:81550
            ---GGAACGCCCTCTTTTAAAAAAG|GTACATATAAATTTGGCTTTATAATTTC------
            SEQUENCER02:115:A8164TABXX:1:2106:2842:149266
            ---GGAACGCCCTCTTTTAAAAAAG|GTACATATAAATTTGGCTTTATAATTTC------
            SEQUENCER02:115:A8164TABXX:1:2202:19333:40567
            ---GGAACGCCCTCTTTTAAAAAAG|GTACATATAAATTTGGCTTTATAATTTC------
            SEQUENCER02:115:A8164TABXX:1:2208:16118:108515
###############################################################################
115TTTAGGC_1   -chr20:477790732 +chr20:39690034   STAU1_TOP1
       acceptor_genomic_template
*******************************************************************************
```

```
###############################################################################
#####
115TTAGGC_6      -chr15:68695257_+chr17:80417868    ITGA11_NARF  acceptor_template
********************************************************************************
**********
GCCTCCCGCCCGCGCGGCTCCAGATGAAGTGTGAGCACTGCACGCGCAAG|GAATGTAGTAAGAAAACAAAAACTGATGACCAAGAA
TGTGTCAGCCGA  junction_+chr17_80416706_+chr17_80417868_NM_012336
################################################################################
###########
115TTAGGC_6      -chr15:68695257_+chr17:80417868    ITGA11_NARF  donor_genomic_template
********************************************************************************
***********
GCCTTCTTTGGCTACACAGTGCAGCACGACGACATCAGTGGCAATAAGTG|GTGAGTGAGAGCGGCCGCCCCACCCAGCCCTGTACCA
TTCCACACCCAG  junction_-chr15_68695257_NM_001004439
################################################################################
###########
115TTAGGC_6      -chr15:68695257_+chr17:80417868    ITGA11_NARF
        acceptor_genomic_template
********************************************************************************
***********
AAGGGAGACGAAGTAAAAGTTCATTGATAATGTTCCTTTGCTTTTTAAG|GAATGTAGTAAGAAAACAAAAACTGATGACCAAGAA
TGTGTCAGCCGA  junction_+chr17_80417868_NM_012336
################################################################################
###########
```

FIGURE 3.78B

```
3.79 SAV1_NIN
116GCCAAT_3      -chr14:51131897_-chr14:51245522    SAV1_NIN  fusion_template
********************************************************************************
**********
CCATGATCTCTTCCAAAGAATGCCACAGAATCAGGGGAGGCATGCTTCAG|CACTGGAAGACGCAACGCAGTGAGGAGTATGAAGCGGA
AGGCCAGTTAAG  junction_-chr14_51131897_-chr14_51245522_NM_021818_NM_016350
```

FIGURE 3.79A

```
----------------------------------------CAGGGGAGGCATGCTTCAG|CACTGGAAGACGCAACGCAGTGAGGAGTATG---------
                   SEQUENCER02:116:B815YJABXX:3:1107:12857:79243
----------------------------------------AGGGGAGGCATGCTTCAG|CACTGGAAGACGCAACGCAGTGAGGAGTATG---------
                   SEQUENCER02:116:B815YJABXX:3:1206:10878:136989
----------------------------------------AGGGGAGGCATGCTTCAG|CACTGGAAGACGCAACGCAGTGAGGAGTATG---------
                   SEQUENCER02:116:B815YJABXX:3:1206:12591:43871
###############################################################################################
###############
116GCCAAT_3     -chr14:51131897_-chr14:51245522     SAV1_NIN_donor_template
****************************************                    **********************************
CCATGATCTCTTCCAAAGAATGCCACAGAATCAGGGGAGGCATGCTTCAG|GTATTGGGAGAGTTGCTGCTACATCTTTAGGAAATTTG
ACTAACCATGGT     junction_-chr14_51131897_-chr14_51111732_NM_021818
------------------------------------TCAGGGGAGGCATGCTTCAG|GTATTGGGAGAGTTGCTGCTACATCTTTAG-------
                   SEQUENCER02:116:B815YJABXX:3:1108:1477:162135
------------------------------------TCAGGGGAGGCATGCTTCAG|GTATTGGGAGAGTTGCTGCTACATCTTTAG-------
                   SEQUENCER02:116:B815YJABXX:3:2206:13141:116818
-------------------------------------AGGGGAGGCATGCTTCAG|GTATTGGGAGAGTTGCTGCTACATCTTTAGG------
                   SEQUENCER02:116:B815YJABXX:3:1101:1503:5292
-------------------------------------AGGGGAGGCATGCTTCAG|GTATTGGGAGAGTTGCTGCTACATCTTTAGG------
                   SEQUENCER02:116:B815YJABXX:3:1107:5202:123881
-------------------------------------AGGGGAGGCATGCTTCAG|GTATTGGGAGAGTTGCTGCTACATCTTTAGG------
                   SEQUENCER02:116:B815YJABXX:3:1202:19717:132136
-------------------------------------AGGGGAGGCATGCTTCAG|GTATTGGGAGAGTTGCTGCTACATCTTTAGG------
                   SEQUENCER02:116:B815YJABXX:3:1206:5832:198824
-------------------------------------AGGGGAGGCATGCTTCAG|GTATTGGGAGAGTTGCTGCTACATCTTTAGG------
                   SEQUENCER02:116:B815YJABXX:3:2107:15058:106400
-------------------------------------AGGGGAGGCATGCTTCAG|GTATTGGGAGAGTTGCTGCTACATCTTTAGG------
                   SEQUENCER02:116:B815YJABXX:3:2205:1252:113337
--------------------------------------GGGGAGGCATGCTTCAG|GTATTGGGAGAGTTGCTGCTACATCTTTAGGAA----
                   SEQUENCER02:116:B815YJABXX:3:1207:18808:6848
--------------------------------------GGGGAGGCATGCTTCAG|GTATTGGGAGAGTTGCTGCTACATCTTTAGGAA----
                   SEQUENCER02:116:B815YJABXX:3:1208:11176:176008
```

```
CCATGATCATCTCTTCCAAAGAATGCCACAGAATCAGGGGAGGCATGCTTCAG|GTAGCTTAACATTATAAATAATATAGTAGTTTATATTT
ATTGACACATGTCA    junction -chr14:51131897_-chr14:51131897_NM_021818
####################################################################################
116GCCAAT_3       -chr14:51131897_-chr14:51245522     SAV1_NIN    acceptor_genomic_template
*************************************************************************************

TCTTTCTGAATAAGTTCTAAAGCACACTAATCTTCTCTTGCCTTCTCTAG|CACTGGAAGACGCAACGCAGTGAGGAGTATGAAGCGGA
AGGTAAGAGCCG      junction -chr14:51245522_NM_016350
####################################################################################
####################

FIGURE 3.79D 3.80 EIF2C3_ZP2
119GCCAAT_1    +chr1:36492899_-chr16:212112879       EIF2C3_ZP2    fusion_template
*************************************************************************************
TGGCCTACAGCTTATTATCGTCATCCTCGCCGGGAAGAGACACCAGTGTATG|ATAATTCCTACCAACAACCTTATGGGAAAACGAGTAC
CCTCTAGTGAGA   junction +chr1_36492899_-chr16_21212879_NM_024852_NM_003460
------------------GCCGGGAAGAGACACCAGTGTATG|ATAATTCCTACCAACAACCTTATGGGG--------
              SEQUENCER02:119:A815MMABXX:1:1205:10805:191145
------------------GCCGGGAAGAGACACCAGTGTATG|ATAATTCCTACCAACAACCTTATGGGG--------
              SEQUENCER02:119:A815MMABXX:1:2107:17803:102328
------------------GCCGGGAAGAGACACCAGTGTATG|ATAATTCCTACCAACAACCTTATGGGG--------
              SEQUENCER02:119:A815MMABXX:1:2202:15016:159108
--------------------GGGAAGAGACACCAGTGTATG|ATAATTCCTACCAACAACCTTATGGGAAA-------
              SEQUENCER02:119:A815MMABXX:1:2101:8417:153193
####################################################################################
119GCCAAT_1    +chr1:36492899_-chr16:212112879       EIF2C3_ZP2    donor_template
*************************************************************************************

FIGURE 3.80A
```

FIGURE 3.80B 3.81 ACSL3_MOGAT1

```
3.81 ACSL3_MOGAT1    fusion_template
119GCCAAT_1    +chr2:223725976_+chr2:223553063    ACSL3_MOGAT1    fusion_template
********************************************************************************
CCAGGCCTGCCGCGGGCCGAGGCCGGAGGAACCCGGACTCCGGCGTAGCG|GGCCGATGTCCATTGGAATCACTGTGATGCTGATCATA
CACAACTATTTG    junction_+chr2_223725976_+chr2_223553063_NM_004457_NM_058165
------------GCCGGAGGAACCCGGACTCCGGCGTAGCG|GGCCGATGTCCATTGGAATC------
       SEQUENCER02:119:A815MMABXX:1:1106:19697:184156
------------GCCGGAGGAACCCGGACTCCGGCGTAGCG|GGCCGATGTCCATTGGAATC------
       SEQUENCER02:119:A815MMABXX:1:2101:14219:65766
------------GCCGGAGGAACCCGGACTCCGGCGTAGCG|GGCCGATGTCCATTGGAATC------
       SEQUENCER02:119:A815MMABXX:1:2103:18938:128472
###############################################################################

119GCCAAT_1    +chr2:223725976_+chr2:223553063    ACSL3_MOGAT1    donor_template
********************************************************************************
CCAGGCCTGCCGCGGGCCGAGGCCGGAGGAACCCGGACTCCGGCGTAGCG|GTTTTGACACAAGGGCGCATATCTTCAAAGCACCTAGT
ACCTCCTACCAT    junction_+chr2_223725976_+chr2_223553063_NM_004457
------------GACTCCGGCGTAGCG|GTTTTGACACAAGGGCGCATATCTTCAAAGCACCT---
       SEQUENCER02:119:A815MMABXX:1:2202:20885:34209
CCGGCGTAGCG|GTTTTGACACAAGGGCGCATATCTTCAAAGCACCTAGTA---
       SEQUENCER02:119:A815MMABXX:1:1208:19052:32945
GTAGCG|GTTTTGACACAAGGGCGCATATCTTCAAAGCACCTAGTACCTCC------
       SEQUENCER02:119:A815MMABXX:1:2202:7454:92394
###############################################################################
```

FIGURE 3.81A

```
119GCCAAT_1      +chr2:223725976_+chr2:223553063      ACSL3_MOGAT1    acceptor_template
***********************************************************************************
*********
GCTGCAGACGCTGGCCGTGCTGCAGTGGCTCCTGAAATACTGCTGCTCG|GGCCGATGTCCATTGAATCACTGTGATGCTGATCATA
CACAACTATTTG   junction +chr2_223536598_+chr2_223553063_NM_058165
###################################################################################
#########
119GCCAAT_1      +chr2:223725976_+chr2:223553063      ACSL3_MOGAT1    donor_genomic_template
***********************************************************************************
*********
CCAGGCCTGCGCGGGCCCGAGGCCGGAGGAACCCGGACTCCGGCGTAGCG|GTGAGTGCGGCGCCGGTTGTGGGAGCGGGGAGCCGG
TTGGCGGCGCGG   junction +chr2_223725976_NM_004457
###################################################################################
#########
119GCCAAT_1      +chr2:223725976_+chr2:223553063      ACSL3_MOGAT1    
            acceptor_genomic_template
***********************************************************************************
*********
TGAGCAGATACTAACAGACTGATTCCATGAGACTTTTCTTTTCTTACAG|GGCCCGATGTCCATTGAATCACTGTGATGCTGATCATA
CACAACTATTTG   junction +chr2_223553063_NM_058165
###################################################################################
#########
```

FIGURE 3.81B 3.82 NFYA_TDRG1
```
119GCCAAT_1      +chr6:41040823_+chr6:40347021      NFYA_TDRG1    fusion_template
***********************************************************************************
*********
CGGTACTGGAGCCAATCAGCGCGGCAGCCGGGAGCCGGGAGGCACG|GAACGGTCACTGCGCAGGATCAAGCTACAATGAAGAGG
AGGGAGGCAGTC   junction +chr6_41040823_+chr6_40347021_NM_002505_NR_024015
------------CGCGGGCAGCAGCGAACCGGGAGCCGGGAGGCACG|GAACGGTCACTGCGCAGGA--------------
            SEQUENCER02:119:A815MMABXX:1:2207:18815:73793
--------------------GGGGGAGCGGAGGCACG|GAACGGTTACTGCGCAGGATCAAGCTACAATGAA-------
            SEQUENCER02:119:A815MMABXX:1:2206:12754:60480
```

FIGURE 3.82A

```
################################################################################
######################
119GCCAAT_1      +chr6:41040823_+chr6:40347021 NFYA_TDRG1    donor_template
*************************************************************************

CGGTACTGGAGCCAATCAGCGCGGCAGCGAACCGGGAGCGAGGCACG|GAGTGTACCTCACAGCCTTCTAGGATCTCCAGAGTGGA
CAGGAATCTCAC   junction +chr6_41040823_+chr6_41046768_NM_002505
################################################################################
#########
119GCCAAT_1      +chr6:41040823_+chr6:40347021 NFYA_TDRG1    acceptor_template
***********************************************************************

TCCAGCATTTGTGCCCGGTCCGCCCCTCCGGCCTGACTCTTTCCGT|GAACGGTCACTGCGCAGGATCAAGCTACAATGAAGAGG
AGGGAGGCAGTC   junction +chr6_40346636_+chr6_40347021_NR_024015
################################################################################
###############
119GCCAAT_1      +chr6:41040823_+chr6:40347021 NFYA_TDRG1    donor_genomic_template
***********************************************************************

CGGTACTGGAGCCAATCAGCGCGGCAGCGAACCGGGAGCGAGGCACG|GTGAGTGTGAGGAGCCAATATCCAGCGGCCCAGAGCCG
GCCCCAGGCCCC   junction +chr6_41040823_NM_002505
--------------------------------------------------------------------

AGGCACG|GTGAGTGTGAGGAGCCAATATCCAGCGGCCCAGAGCCGGGCCCC------
   SEQUENCER02:119:A815MMABXX:1:2102:14839:108362
################################################################################
#########
119GCCAAT_1      +chr6:41040823_+chr6:40347021 NFYA_TDRG1    acceptor_genomic_template
***********************************************************************

TTGTCTTCCTATGTATCAAGTTTCTTCTGATTTTTTTTTTTCTTTTATAG|GAACGGTCACTGCGCAGGATCAAGCTACAATGAAGAGG
AGGGAGGCAGTC   junction +chr6_40347021_NR_024015
################################################################################
########
```

FIGURE 3.82B 3.83 BCL7A_C12orf42

```
121TTAGGC_4      +chr12:122473333_-chr12:103872225  BCL7A_C12orf42 fusion_template
***********************************************************************************
GGTGACCACTCCGGAGAACAGTTCCTCCCCAGGGATGATGGACATGCATG|GGAGTTGAACTTGTCAAATTAATGTCTACAGTGATATG
TATGAAACAAAG   junction_+chr12_122473333_-chr12_103872225_NM_020993_NM_198521
-----------------AGGGATGATGGACATGCATG|GGAGTTGAACTTGTCAAATTAATGTCTACA--------
##############################################################################
          SEQUENCER02:121:A8164KABXX:4:2101:16446:146093

121TTAGGC_4      +chr12:122473333_-chr12:103872225  BCL7A_C12orf42 donor_template
***********************************************************************************
GGTGACCACTCCGGAGAACAGTTCCTCCCCAGGGATGATGGACATGCATG|ACGATAACAGCAACCAGAGCTCCATGCAGATGCCTCC
CCCATCAAACAG   junction_+chr12_122473333_+chr12_122481792_NM_020993
##############################################################################

121TTAGGC_4      +chr12:122473333_-chr12:103872225  BCL7A_C12orf42 acceptor_template
***********************************************************************************
GCGGAGGAGGCTGCGGGCGCCCCGGGCGCGCCCCCAGG|GGAGTTGAACTTGTCAAATTAATGTCTACAGTGATATG
TATGAAACAAAG   junction_-chr12_103889680_-chr12_103872225_NM_198521
##############################################################################

121TTAGGC_4      +chr12:122473333_-chr12:103872225  BCL7A_C12orf42 donor_genomic_template
***********************************************************************************
GGTGACCACTCCGGAGAACAGTTCCTCCCCAGGGATGATGGACATGCATG|GTGAGTGCCCATGGCTCCTCCTGCCCAGCC
CGGGGCCTTGGC   junction_+chr12_122473333_NM_020993
```

FIGURE 3.83A

```
################################################################################
################
121TTAGGC_4       +chr12:122473333_-chr12:103872225   BCL7A_C12orf42
          acceptor_genomic_template
****************************************************************************
TCATTGCATCATTGTAAACCTGCTCTTCTTTTCCATTCTTTGTTTATAG|GGAGTTGAACTTGTCAAATTAATGTCTACAGTGATATG
TATGAAACAAAG    junction  -chr12_103872225_NM_198521
################################################################################
##########
```

FIGURE 3.83B

```
3.84 TRPS1_EIF3H
121TTAGGC_4    -chr8:116680772_-chr8:117671219    TRPS1_EIF3H    fusion_template
****************************************************************************
CGCCACCATCTTTCGGGCTGCCGAGGGTGTTCTTGACGATTAATCAACAG|TCCAATATCAGATGGAAATGATGCGGAGCCTTCGCCAT
GTAAACATTGAT   junction  -chr8_116680772_-chr8_117671219_NM_014112_NM_003756
****************************************************************************
-------TTCGGGCTGCCGAGGGTGTTCTTGACGATTAATCAACAG|TCCAATATCAG----------------------
         SEQUENCER02:121:A8164KABXX:4:2102:15082:81828
-------TTCGGGCTGCCGAGGGTGTTCTTGACGATTAATCAACAG|TCCAATATCAG----------------------
         SEQUENCER02:121:A8164KABXX:4:2206:10287:18476
----CGGGCTGCCGAGGGTGTTCTTGACGATTAATCAACAG|TCCAATATCAGAT-------------------------
         SEQUENCER02:121:A8164KABXX:4:2108:7863:48366
----CGGGCTGCCGAGGGTGTTCTTGACGATTAATCAACAG|TCCAATATCAGAT-------------------------
         SEQUENCER02:121:A8164KABXX:4:2204:18654:80220
----CGGGCTGCCGAGGGTGTTCTTGACGATTAATCAACAG|TCCAATATCAGAT-------------------------
         SEQUENCER02:121:A8164KABXX:4:2208:9225:126021
----GGCTGCCGAGGGTGTTCTTGACGATTAATCAACAG|TCCAATATCAGATGG-------------------------
         SEQUENCER02:121:A8164KABXX:4:1207:20710:143588
----GGCTGCCGAGGGTGTTCTTGACGATTAATCAACAG|TCCAATATCAGATGG-------------------------
         SEQUENCER02:121:A8164KABXX:4:2102:1467:39648
```

FIGURE 3.84A

```
----GGCTGCCGAGGGTGTTCTTGACGATTAATCAACAG|TCCAATATCAGATGG-----
---- SEQUENCER02:121:A8164KABXX:4:2106:17433:114080
----GGCTGCCGAGGGTGTTCTTGACGATTAATCAACAG|TCCAATATCAGATGG-----
---- SEQUENCER02:121:A8164KABXX:4:2208:5835:68681
----GCTGCCGAGGGTGTTCTTGACGATTAATCAACAG|TCCAATATCAGATGGA-----
---- SEQUENCER02:121:A8164KABXX:4:1104:6644:112358
----GCTGCCGAGGGTGTTCTTGACGATTAATCAACAG|TCCAATATCAGATGGA-----
---- SEQUENCER02:121:A8164KABXX:4:1106:1660:147530
----GCTGCCGAGGGTGTTCTTGACGATTAATCAACAG|TCCAATATCAGATGGA-----
---- SEQUENCER02:121:A8164KABXX:4:1107:14017:80842
----GCTGCCGAGGGTGTTCTTGACGATTAATCAACAG|TCCAATATCAGATGGA-----
---- SEQUENCER02:121:A8164KABXX:4:1207:18365:67480
----GCTGCCGAGGGTGTTCTTGACGATTAATCAACAG|TCCAATATCAGATGGA-----
---- SEQUENCER02:121:A8164KABXX:4:1208:11432:8822
----GCTGCCGAGGGTGTTCTTGACGATTAATCAACAG|TCCAATATCAGATGGA-----
---- SEQUENCER02:121:A8164KABXX:4:1208:3166:108354
----GCTGCCGAGGGTGTTCTTGACGATTAATCAACAG|TCCAATATCAGATGGA-----
---- SEQUENCER02:121:A8164KABXX:4:1208:3754:35891
----GCTGCCGAGGGTGTTCTTGACGATTAATCAACAG|TCCAATATCAGATGGA-----
---- SEQUENCER02:121:A8164KABXX:4:2101:16333:3391
----GCTGCCGAGGGTGTTCTTGACGATTAATCAACAG|TCCAATATCAGATGGA-----
---- SEQUENCER02:121:A8164KABXX:4:2103:16242:117461
----GCTGCCGAGGGTGTTCTTGACGATTAATCAACAG|TCCAATATCAGATGGA-----
---- SEQUENCER02:121:A8164KABXX:4:2105:13563:139591
----GCTGCCGAGGGTGTTCTTGACGATTAATCAACAG|TCCAATATCAGATGGA-----
---- SEQUENCER02:121:A8164KABXX:4:2108:8312:152211
----GCTGCCGAGGGTGTTCTTGACGATTAATCAACAG|TCCAATATCAGATGGA-----
---- SEQUENCER02:121:A8164KABXX:4:2207:13636:90470
----GCTGCCGAGGGTGTTCTTGACGATTAATCAACAG|TCCAATATCAGATGGA-----
---- SEQUENCER02:121:A8164KABXX:4:2208:10775:166924
-----GCCGAGGGTGTTCTTGACGATTAATCAACAG|TCCAATATCAGATGGAAAT----
---- SEQUENCER02:121:A8164KABXX:4:1103:5504:38708
```

FIGURE 3.84B

```
----------GCCGAGGGTGTTCTTGACGATTAATCAACAG|TCCAATATCAGATGGAAAT----------  SEQUENCER02:121:A8164KABXX:4:1104:2941:145880
----------GCCGAGGGTGTTCTTGACGATTAATCAACAG|TCCAATATCAGATGGAAAT----------  SEQUENCER02:121:A8164KABXX:4:1104:7869:169252
----------GCCGAGGGTGTTCTTGACGATTAATCAACAG|TCCAATATCAGATGGAAAT----------  SEQUENCER02:121:A8164KABXX:4:1106:7569:197277
----------GCCGAGGGTGTTCTTGACGATTAATCAACAG|TCCAATATCAGATGGAAAT----------  SEQUENCER02:121:A8164KABXX:4:1107:13492:143850
----------GCCGAGGGTGTTCTTGACGATTAATCAACAG|TCCAATATCAGATGGAAA-----------  SEQUENCER02:121:A8164KABXX:4:1107:4557:139361
----------GCCGAGGGTGTTCTTGACGATTAATCAACAG|TCCAATATCAGATGGAAAT----------  SEQUENCER02:121:A8164KABXX:4:1107:5889:73330
----------GCCGAGGGTGTTCTTGACGATTAATCAACAG|TCCAATATCAGATGGAAAT----------  SEQUENCER02:121:A8164KABXX:4:1201:10588:27074
----------GCCGAGGGTGTTCTTGACGATTAATCAACAG|TCCAATATCAGATGGAAAT----------  SEQUENCER02:121:A8164KABXX:4:1202:19520:73815
----------GCCGAGGGTGTTCTTGACGATTAATCAACAG|TCCAATATCAGATGGAAAT----------  SEQUENCER02:121:A8164KABXX:4:1202:3809:137435
----------GCCGAGGGTGTTCTTGACGATTAATCAACAG|TCCAATATCAGATGGAAAT----------  SEQUENCER02:121:A8164KABXX:4:1202:8118:62369
----------GCCGAGGGTGTTCTTGACGATTAATCAACAG|TCCAATATCAGATGGAAAT----------  SEQUENCER02:121:A8164KABXX:4:1207:5509:28345
----------GCCGAGGGTGTTCTTGACGATTAATCAACAG|TCCAATATCAGATGGAAAT----------  SEQUENCER02:121:A8164KABXX:4:1208:19791:79614
----------GCCGAGGGTGTTCTTGACGATTAATCAACAG|TCCAATATCAGATGGAAAT----------  SEQUENCER02:121:A8164KABXX:4:2102:21354:71008
----------GCCGAGGGTGTTCTTGACGATTAATCAACAG|TCCAATATCAGATGGAAAT----------  SEQUENCER02:121:A8164KABXX:4:2202:1687:16157
----------GCCGAGGGTGTTCTTGACGATTAATCAACAG|TCCAATATCAGATGGAAAT----------  SEQUENCER02:121:A8164KABXX:4:2203:3897:166306
----------GCCGAGGGTGTTCTTGACGATTAATCAACAG|TCCAATATCAGATGGAA-------------  SEQUENCER02:121:A8164KABXX:4:2204:18569:23489
```

FIGURE 3.84C

```
                                    ------GCCGAGGGTGTTCTTGACGATTAATCAACAG|TCCAATATCAGATGGAAAT-------
                                    ------SEQUENCER02:121:A8164KABXX:4:2205:8616:164911
                                    ------SEQUENCER02:121:A8164KABXX:4:2206:15715:164137
                                    ---CGAGGGTGTTCTTGACGATTAATCAACAG|TCCAATATCAGATGGAAATGA-----
                                    ---SEQUENCER02:121:A8164KABXX:4:1108:7086:27860
                                    ---CGAGGGTGTTCTTGACGATTAATCAACAG|TCCAATATCAGATGGAAATGA-----
                                    ---SEQUENCER02:121:A8164KABXX:4:1201:19141:10745
                                    ----CGAGGGTGTTCTTGACGATTAATCAACAG|TCCAATATCAGATGGAAATGA----
                                    ----SEQUENCER02:121:A8164KABXX:4:1205:9516:139480
                                    -----CGAGGGTGTTCTTGACGATTAATCAACAG|TCCAATATCAGATGGAAATGA---
                                    -----SEQUENCER02:121:A8164KABXX:4:2108:18183:39370
TAATCAACAG|TCCAATATCAGATGGAAATGATGCCGAGCCTTCGCCATGT-------------
          SEQUENCER02:121:A8164KABXX:4:1104:18769:151948
TAATCAACAG|TCCAATATCAGATGGAAATGATGCCGAGCCTTCGCCATGT###############################
          SEQUENCER02:121:A8164KABXX:4:2208:16620:144897
###########################################################################
121TTAGGC_4   -chr8:116680772_-chr8:117671219    TRPS1_EIF3H   donor_template
**************************************************************************
CGCCACCATCTTCGGCTGCCGAGGGTGTTCTTGACGATTAATCAACAG|ATGTACAGATCAGCTCTCAAAATGTCTTCTCTGTGTCTTC
TGAGCGTCTTCT junction -chr8_116680772_-chr8_116635985_NM_014112
            -GCTGCCGAGGGTGTTCTTGACGATTAATCAACAG|ATGTACAGATCAGCTC--------
            -SEQUENCER02:121:A8164KABXX:4:1104:12122:55954
            -GCTGCCGAGGGTGTTCTTGACGATTAATCAACAG|ATGTACAGATCAGCTC--------
            -SEQUENCER02:121:A8164KABXX:4:1207:15192:39413
            -GCTGCCGAGGGTGTTCTTGACGATTAATCAACAG|ATGTACAGATCAGCTC--------
            -SEQUENCER02:121:A8164KABXX:4:1207:6880:168393
            -GCTGCCGAGGGTGTTCTTGACGATTAATCAACAG|ATGTACAGATCAGCTC--------
            -SEQUENCER02:121:A8164KABXX:4:2207:14119:51896
```

```
                                                                                                                                       *************
                                                                                                                                       *************
AACATCATTAAAAGTTTTTCTTTTAATTTCCTCTTCCCCATCATCCAG|TCCAATATCAGATGGAAATGATGCGGAGCCTTCGCCAT
GTAAACATTGAT  junction_-chr8_117671219_NM_003756
#############################################################################################
############
```

FIGURE 3.84F

```
3.85 RAD21_FER1L6
139TTAGGC_5   -chr8:117878825_+chr8:124968232   RAD21_FER1L6_fusion_template
*************************************************************************************************
TGTTCGAGTGTAATTTAGAGAGCAGCGTGGAGAGTATCATCTCACCAAAG|AAAGGGATGTGTTTGGGCTGAAGGTGAAGAAGAAGAGAA
ATAAGGCAGAGA   junction_-chr8_117878825_+chr8_124968232_NM_006265_NM_001039112
------------   -----------GAGCAGCGTGGAGAGTATCATCTCACCAAAG|AAAGGGATGTTTGGGCTG-------------
                          SEQUENCER02:139:815P4ABXX:5:1108:2673:57078
------------   -----------GAGCAGCGTGGAGAGTATCATCTCACCAAAG|AAAGGGATGTTTGGGCTG-------------
                          SEQUENCER02:139:815P4ABXX:5:2206:3916:76700
###########################################################################################
############
139TTAGGC_5   -chr8:117878825_+chr8:124968232   RAD21_FER1L6_donor_template
*************************************************************************************************
TGTTCGAGTGTAATTTAGAGAGCAGCGTGGAGAGTATCATCTCACCAAAG|GTGAAAATGGCATTACGGACATCAGGACATCTCTTACT
GGGAGTAGTTCG   junction_-chr8_117878825_-chr8_117875498_NM_006265
------------   ------GAGAGCAGTGTGGAGAGTATCATCTCACCAAAG|GTGAAAATGGCATTACG------------
                       SEQUENCER02:139:815P4ABXX:5:1104:2066:60610
------------   ---------GAGAGCAGTGTGGAGAGTATCATCTCACCAAAG|GTGAAAATGGCATTACG------------
                          SEQUENCER02:139:815P4ABXX:5:1208:3830:81845
------------   -----------AGAGCAGCGTGGAGAGTATCATCTCACCAAAG|GTGAAAATGGCATTACGG------------
                          SEQUENCER02:139:815P4ABXX:5:1106:3560:169730
------------   -----------AGAGCAGCGTGGAGAGTATCATCTCACCAAAG|GTGAAAATGGCATTACGG------------
                          SEQUENCER02:139:815P4ABXX:5:1203:14050:191491
```

FIGURE 3.85A

```
         -----AGAGCAGCGTGGAGAGTATCATCTCACCAAAG|GTGAAAATGGCATTACGG------
SEQUENCER02:139:815P4ABXX:5:2108:3772:194285
         -----AGAGCAGCGTGGAGAGTATCATCTCACCAAAG|GTGAAAATGGCATTACGG------
SEQUENCER02:139:815P4ABXX:5:2201:4373:137974
         -----AGAGCAGCGTGGAGAGTATCATCTCACCAAAG|GTGAAAATGGCATTACGG------
SEQUENCER02:139:815P4ABXX:5:2206:2500:45877
         -------GAGCAGCGTGGAGAGTATCATCTCACCAAAG|GTGAAAATGGCATTACGGA-----
SEQUENCER02:139:815P4ABXX:5:1204:6932:163639
         -------GAGCAGCGTGGAGAGTATCATCTCACCAAAG|GTGAAAATGGCATTACGGA-----
SEQUENCER02:139:815P4ABXX:5:1205:20256:172138
         -------GAGCAGCGTGGAGAGTATCATCTCACCAAAG|GTGAAAATGGCATTACGGA-----
SEQUENCER02:139:815P4ABXX:5:2103:15877:96508
         -------GAGCAGCGTGGAGAGTATCATCTCACCAAAG|GTGAAAATGGCATTACGGA-----
SEQUENCER02:139:815P4ABXX:5:2201:3425:64512
         -------GAGCAGCGTGGAGAGTATCATCTCACCAAAG|GTGAAAATGGCATTACGGA-----
SEQUENCER02:139:815P4ABXX:5:2201:6710:96493
         -------GAGCAGCGTGGAGAGTATCATCTCACCAAAG|GTGAAAATGGCATTACGGA-----
SEQUENCER02:139:815P4ABXX:5:2207:11906:76970
         --------AGCAGCGTGGAGAGTATCATCTCACCAAAG|GTGAAAATGGCATTACGGAC----
SEQUENCER02:139:815P4ABXX:5:1107:12962:185371
         --------AGCAGCGTGGAGAGTATCATCTCACCAAAG|GTGAAAATGGCATTACGGAC----
SEQUENCER02:139:815P4ABXX:5:1107:13460:168567
         --------AGCAGCGTGGAGAGTATCATCTCACCAAAG|GTGAAAATGGCATTACGGAC----
SEQUENCER02:139:815P4ABXX:5:1107:17931:199879
         --------AGCAGCGTGGAGAGTATCATCTCACCAAAG|GTGAAAATGGCATTACGGAC----
SEQUENCER02:139:815P4ABXX:5:1201:10647:190018
         --------AGCAGCGTGGAGAGTATCATCTCACCAAAG|GTGAAAATGGCATTACGGAC----
SEQUENCER02:139:815P4ABXX:5:1203:14881:164825
         --------AGCAGCGTGGAGAGTATCATCTCACCAAAG|GTGAAAATGGCATTACGGAC----
SEQUENCER02:139:815P4ABXX:5:1205:15604:85913
         --------AGCAGCGTGGAGAGTATCATCTCACCAAAG|GTGAAAATGGCATTACGGAC----
SEQUENCER02:139:815P4ABXX:5:1206:3711:123307
```

FIGURE 3.85B

```
-------------AGCAGCGTGGAGAGTATCATCTCACCAAAG|GTGAAAATGGCATTACGGAC-------
------SEQUENCER02:139:815P4ABXX:5:1207:15597:132229
-------------AGCAGCGTGGAGAGTATCATCTCACCAAAG|GTGAAAATGGCATTACGGAC-------
------SEQUENCER02:139:815P4ABXX:5:1208:1040:73189
-------------AGCAGCGTGGAGAGTATCATCTCACCAAAG|GTGAAAATGGCATTACGGAC-------
------SEQUENCER02:139:815P4ABXX:5:1208:3706:171194
-------------AGCAGCGTGGAGAGTATCATCTCACCAAAG|GTGAAAATGGCATTACGGAC-------
------SEQUENCER02:139:815P4ABXX:5:2101:3707:10924
-------------AGCAGCGTGGAGAGTATCATCTCACCAAAG|GTGAAAATGGCATTACGGAC-------
------SEQUENCER02:139:815P4ABXX:5:2101:7390:92662
-------------AGCAGCGTGGAGAGTATCATCTCACCAAAG|GTGAAAATGGCATTACGGAC-------
------SEQUENCER02:139:815P4ABXX:5:2102:5343:139344
-------------AGCAGCGTGGAGAGTATCATCTCACCAAAG|GTGAAAATGGCATTACGGAC-------
------SEQUENCER02:139:815P4ABXX:5:2103:15452:61100
-------------AGCAGCGTGGAGAGTATCATCTCACCAAAG|GTGAAAATGGCATTACGGAC-------
------SEQUENCER02:139:815P4ABXX:5:2103:3313:150395
-------------AGCAGCGTGGAGAGTATCATCTCACCAAAG|GTGAAAATGGCATTACGGAC-------
------SEQUENCER02:139:815P4ABXX:5:2201:3148:149760
-------------AGCAGCGTGGAGAGTATCATCTCACCAAAG|GTGAAAATGGCATTACGGAC-------
------SEQUENCER02:139:815P4ABXX:5:2201:6524:84509
-------------AGCAGCGTGGAGAGTATCATCTCACCAAAG|GTGAAAATGGCATTACGGAC-------
------SEQUENCER02:139:815P4ABXX:5:2202:7128:169715
-------------AGCAGCGTGGAGAGTATCATCTCACCAAAG|GTGAAAATGGCATTACGGAC-------
------SEQUENCER02:139:815P4ABXX:5:2205:3810:93330
------------AGCAGCGTGGAGAGTATCATCTCACCAAAG|GTGAAAATGGCATTACGGAC-------
------SEQUENCER02:139:815P4ABXX:5:2207:15011:68297
------------AGCAGCGTGGAGAGTATCATCTCACCAAAG|GTGAAAATGGCATTACGGAC-------
------SEQUENCER02:139:815P4ABXX:5:2208:12647:12426
------------GCAGCGTGGAGAGTATCATCTCACCAAAG|GTGAAAATGGCATTACGGACA------
------SEQUENCER02:139:815P4ABXX:5:1102:18775:141661
------------GCAGCGTGGAGAGTATCATCTCACCAAAG|GTGAAAATGGCATTACGGACA------
------SEQUENCER02:139:815P4ABXX:5:1102:20622:51346
```

FIGURE 3.85C

```
--------GCAGCGTGGAGAGTATCATCTCACCAAAAG|GTGAAAATGGCATTACGGACA--------  SEQUENCER02:139:815P4ABXX:5:1108:14335:87298
--------GCAGCGTGGAGAGTATCATTTCACCAAAG|GTGAAAATGGCATTACGGACA--------  SEQUENCER02:139:815P4ABXX:5:2102:16844:157030
--------GCAGCGTGGAGAGTATCATCTCACCAAAG|GTGAAAATGGCATTACGGACA--------  SEQUENCER02:139:815P4ABXX:5:2107:5121:180129
--------GCAGCGTGGAGAGTATCATCTCACCAAAG|GTGAAAATGGCATTACGGACA--------  SEQUENCER02:139:815P4ABXX:5:2108:18175:119223
--------GCAGCGTGGAGAGTATCATCTCACCAAAG|GTGAAAATGGCATTACGGACA--------  SEQUENCER02:139:815P4ABXX:5:2203:13798:86931
--------GCAGCGTGGAGAGTATCATCTCACCAAAG|GTGAAAATGGCATTACGGACA--------  SEQUENCER02:139:815P4ABXX:5:2204:14026:66759
--------GCAGCGTGGAGAGTATCATCTCACCAAAG|GTGAAAATGGCATTACGGACA--------  SEQUENCER02:139:815P4ABXX:5:2204:1456:185058
-------AGCGTGGAGAGTATCATCTCACCAAAG|GTGAAAATGGCATTACGGACATC------  SEQUENCER02:139:815P4ABXX:5:2205:2757:48579
-------AGCGTGGAGAGTATCATCTCACCAAAG|GTGAAAATGGCATTACGGACATC------  SEQUENCER02:139:815P4ABXX:5:1103:2511:31942
-------AGCGTGGAGAGTATCATCTCACCAAAG|GTGAAAATGGCATTACGGACATC------  SEQUENCER02:139:815P4ABXX:5:1106:10939:71786
-------AGCGTGGAGAGTATCATCTCACCAAAG|GTGAAAATGGCATTACGGAC--------  SEQUENCER02:139:815P4ABXX:5:1201:7261:190094
-------AGCGTGGAGAGTATCATCTCACCAAAG|GTGAAAATGGCATTACGGACATC------  SEQUENCER02:139:815P4ABXX:5:1208:6881:30810
------CGTGGAGAGTATCATCTCACCAAAG|GTGAAAATGGCATTACGGACATCAG----  SEQUENCER02:139:815P4ABXX:5:1103:15558:130890
------CGTGGAGAGTATCATCTCACCAAAG|GTGAAAATGGCATTACGGACATCAG----  SEQUENCER02:139:815P4ABXX:5:1105:20028:80089
------CGTGGAGAGTATCATCTCACCAAAG|GTGAAAATGGCATTACGGACATCAG----  SEQUENCER02:139:815P4ABXX:5:1107:8904:58231
------CGTGGAGAGTATCATCTCACCAAAG|GTGAAAATGGCATTACGGACATCAG----  SEQUENCER02:139:815P4ABXX:5:1205:21254:91031
```

FIGURE 3.85D

```
------------CGTGGAGAGTATCATCTCACCAAAG|GTGAAAATGGCATTACGGACATCAG------ SEQUENCER02:139:815P4ABXX:5:1206:15781:4385
------------CGTGGAGAGTATCATCTCACCAAAG|GTGAAAATGGCATTACGGACATCAG------ SEQUENCER02:139:815P4ABXX:5:1208:12762:151727
------------CGTGGAGAGTATCATCTCACCAAAG|GTGAAAATGGCATTACGGACATCAG------ SEQUENCER02:139:815P4ABXX:5:1208:13991:48579
------------CGTGGAGAGTATCATCTCACCAAAG|GTGAAAATGGCATTACGGACATCAG------ SEQUENCER02:139:815P4ABXX:5:2102:13776:112148
------------CGTGGAGAGTATCATCTCACCAAAG|GTGAAAATGGCATTACGGACATCAG------ SEQUENCER02:139:815P4ABXX:5:2102:16832:45356
------------CGTGGAGAGTATCATCTCACCAAAG|GTGAAAATGGCATTACGGACATCAG------ SEQUENCER02:139:815P4ABXX:5:2104:13274:157414
------------CGTGGAGAGTATCATCTCACCAAAG|GTGAAAATGGCATTACGGACATCAG------ SEQUENCER02:139:815P4ABXX:5:2105:3062:25128
------------CGTGGAGAGTATCATCTCACCAAAG|GTGAAAATGGCATTACGGACATCAG------ SEQUENCER02:139:815P4ABXX:5:2105:7259:191235
------------CGTGGAGAGTATCATCTCACCAAAG|GTGAAAATGGCATTACGGACATCAG------ SEQUENCER02:139:815P4ABXX:5:2106:6885:118160
------------CGTGGAGAGTATCATCTCACCAAAG|GTGAAAATGGCATTACGGACATCAG------ SEQUENCER02:139:815P4ABXX:5:2203:19456:2521
------------CGTGGAGAGTATCATCTCACCAAAG|GTGAAAATGGCATTACGGACATCAG------ SEQUENCER02:139:815P4ABXX:5:2205:6389:19059
------------CGTGGAGAGTATCATCTCACCAAAG|GTGAAAATGGCATTACGGACATCAG------ SEQUENCER02:139:815P4ABXX:5:2207:6875:25363
------------CCTGGAGAGTATCATCTCACCAAAG|GTGAAAATGGCATTACGGACATCAG------ SEQUENCER02:139:815P4ABXX:5:2208:20372:167109
------------CGTGGAGAGTATCATCTCACCAAAG|GTGAAAATGGCATTACGGACATCAG------ SEQUENCER02:139:815P4ABXX:5:1102:21029:4192
------------GTGGAGAGTATCATCTCACCAAAG|GTGAAAATGGCATTACGGACATCAGG------ SEQUENCER02:139:815P4ABXX:5:1103:16982:46499
------------GTGGAGAGTATCATCTCACCAAAG|GTGAAAATGGCATTACGGACATCAGG------ SEQUENCER02:139:815P4ABXX:5:1106:1797:83560
```

FIGURE 3.85E

```
------------SEQUENCER02:139:815P4ABXX:5:1108:8336:48170   -------GTGGAGAGTATCATCTCACCAAAG|GTGAAAATGGCATTACGGACATCAGG-------
------------SEQUENCER02:139:815P4ABXX:5:1202:14112:104251 -------GTGGAGAGTATCATCTCACCAAAG|GTGAAAATGGCATTACGGACATCAGG-------
------------SEQUENCER02:139:815P4ABXX:5:1202:17073:136751 -------GTGGAGAGTATCATCTCACCAAAG|GTGAAAATGGCATTACGGACGTCAGG-------
------------SEQUENCER02:139:815P4ABXX:5:1203:16407:165239 -------GTGGAGAGTATCATCTCACCAAAG|GTGAAAATGGCATTACGGACATCAGG-------
------------SEQUENCER02:139:815P4ABXX:5:1205:16094:48351  -------GTGGAGAGTATCATCTCACCAAAG|GTGAAAATGGCATTACGGACATCAGG-------
------------SEQUENCER02:139:815P4ABXX:5:1205:5191:192310  -------GTGGAGAGTATCATCTCACCAAAG|GTGAAAATGGCATTACGGACATCAGG-------
------------SEQUENCER02:139:815P4ABXX:5:1207:13379:4985   -------GTGGAGAGTATCATCTCACCAAAG|GTGAAAATGGCATTACGGACGTCAGG-------
------------SEQUENCER02:139:815P4ABXX:5:2102:8198:88000   -------GTGGAGAGTATCATCTCACCAAAG|GTGAAAATGGCATTACGGACATCAGG-------
------------SEQUENCER02:139:815P4ABXX:5:2103:5365:49323   -------GTGGAGAGTATCATCTCACCAAAG|GTGAAAATGGCATTACGGACATCAGG-------
------------SEQUENCER02:139:815P4ABXX:5:2104:7187:152421  -------GTGGAGAGTATCATCTCACCAAAG|GTGAAAATGGCATTACGGACATCAGG-------
------------SEQUENCER02:139:815P4ABXX:5:2105:14520:73908  -------GTGGAGAGTATCATCTCACCAAAG|GTGAAAATGGCATTACGGACATCAGG-------
------------SEQUENCER02:139:815P4ABXX:5:2105:17656:99435  -------GTGGAGAGTATCATCTCACCAAAG|GTGAAAATGGCATTACGGACGTCAGG-------
------------SEQUENCER02:139:815P4ABXX:5:2106:9299:86943   -------GTGGAGAGTATCATCTCACCAAAG|GTGAAAATGGCATTACGGACATCAGG-------
------------SEQUENCER02:139:815P4ABXX:5:2201:1049:195132  -------GTGGAGAGTATCATCTCACCAAAG|GTGAAAATGGCATTACGGACATCAGG-------
------------SEQUENCER02:139:815P4ABXX:5:2202:12166:109800 -------GTGGAGAGTATCATCTCACCAAAG|GTGAAAATGGCATTACGGACATCAGG-------
------------SEQUENCER02:139:815P4ABXX:5:2203:10132:48662  -------GTGGAGAGTATCATCTCACCAAAG|GTGAAAATGGCATTACGGACGTCAGG-------
```

FIGURE 3.85F

```
------------GTGGAGAGTATCATCTCACCAAAG|GTGAAAATGGCATTACGGACATCAGG------
--------SEQUENCER02:139:815P4ABXX:5:2206:11517:33309
------------GTGGAGAGTATCATCTCACCAAAG|GTGAAAATGGCATTACGGACGTCAGG------
--------SEQUENCER02:139:815P4ABXX:5:2206:1593:55169
------------GTGGAGAGTATCATCTCACCAAAG|GTGAAAATGGCATTACGGACATCAGG------
--------SEQUENCER02:139:815P4ABXX:5:2206:16605:115698
------------GTGGAGAGTATCATCTCACCAAAG|GTGAAAATGGCATTACGGACATCAGG------
--------SEQUENCER02:139:815P4ABXX:5:2206:8691:28787
------------GTGGAGAGTATCATCTCACCAAAG|GTGAAAATGGCATTACGGACATCAGG------
--------SEQUENCER02:139:815P4ABXX:5:2208:5826:69932
------------GTGGAGAGTATCATCTCACCAAAG|GTGAAAATGGCATTACGGACATCAGG------
--------SEQUENCER02:139:815P4ABXX:5:2208:7634:121324
-------------GGAGAGTATCATCTCACCAAAG|GTGAAAATGGCATTACGGACATCAGGAC----
--------SEQUENCER02:139:815P4ABXX:5:1106:2321:48087
-------------GGAGAGTATCATCTCACCAAAG|GTGAAAATGGCATTATGGACATCAGGAC----
--------SEQUENCER02:139:815P4ABXX:5:1108:6867:53435
-------------GGAGAGTATCATCTCACCAAAG|GTGAAAATGGCATTATGGACATCAGGAC----
--------SEQUENCER02:139:815P4ABXX:5:1202:21004:136902
-------------GGAGAGTATCATCTCACCAAAG|GTGAAAATGGCATTACGGACATCAGGAC----
--------SEQUENCER02:139:815P4ABXX:5:1204:19928:145443
-------------GGAGAGTATCATCTCACCAAAG|GTGAAAATGGCATTATGGACATCAGGAC----
--------SEQUENCER02:139:815P4ABXX:5:1205:9993:25549
-------------GGAGAGTATCATCTCACCAAAG|GTGAAAATGGCATTATGGACATCAGGAC----
--------SEQUENCER02:139:815P4ABXX:5:1206:7598:162222
-------------GGAGAGTATCATCTCACCAAAG|GTGAAAATGGCATTATGGACATCAGGAC----
--------SEQUENCER02:139:815P4ABXX:5:1207:9988:102860
-------------GGAGAGTATCATCTCACCAAAG|GTGAAAATGGCATTACGGACATCAGGAC----
--------SEQUENCER02:139:815P4ABXX:5:2205:2350:57574
-------------GGAGAGTATCATCTCACCAAAG|GTGAAAATGGCATTATGGACATCAGGAC----
--------SEQUENCER02:139:815P4ABXX:5:2208:16299:28651
-------------GGAGAGTATCATCTCACCAAAG|GTGAAAATGGCATTACGGACATCAGGAC----
--------SEQUENCER02:139:815P4ABXX:5:2208:16668:196528
```

FIGURE 3.85G

```
                                                             ---------------GGAGAGTATCATCTCACCAAAG|GTGAAAATGGCATTATGGACATCAGGAC----------------
                                                             ###############################################################################
                                                             SEQUENCER02:139:815P4ABXX:5:2208:2938:134252
139TTAGGC_5         -chr8:117878825 +chr8:124968232    RAD21_FER1L6   acceptor_template
*******************************************************************************************************
TGATCAGAGAGCAATGCTGTGTGGACCATCGTGAAGGTGGACAAGGCATTTT|AAAGGGGATGTTTGGGCTGAAGGTGAAGAAGAAGAGAA
ATAAGGCAGAGA        junction +chr8_124864425 +chr8_124968232_NM_001039112
################################################################################
139TTAGGC_5         -chr8:117878825 +chr8:124968232    RAD21_FER1L6   donor_genomic_template
*********************************************
TGTTCGAGTGTAATTTAGAGAGCAGCGTGGAGAGTATCATCTCACCAAAG|GTATGTTTGATGTTTGATGTTGA
TGTTTATTGATA        junction -chr8_117878825 NM_006265
                    -AGAGAGCAGCGTGGAGAGTATCATCTCACCAAAG|GTATGTTTGATGTTTGATGTTGA---------------
                    SEQUENCER02:139:815P4ABXX:5:1107:18489:137541
                    -AGAGAGCAGCGTGGAGAGTATCATCTCACCAAAG|GTATGTTTGATGTTTGATGTTGA---------------
                    SEQUENCER02:139:815P4ABXX:5:2101:6054:34364
                    -AGAGAGCAGCGTGGAGAGTATCATCTCACCAAAG|GTATGTTTGATGTTTGATGTTGA---------------
                    SEQUENCER02:139:815P4ABXX:5:2107:3602:193771
                    -AGAGAGCAGCGTGGAGAGTATCATCTCACCAAAG|GTATGTTTGATGTTTGATGTTGA---------------
                    SEQUENCER02:139:815P4ABXX:5:2107:3656:153600
                    -AGAGAGCAGCGTGGAGAGTATCATCTCACCAAAG|GTATGTTTGATGTTTGATGTTGA---------------
                    SEQUENCER02:139:815P4ABXX:5:2108:6907:178596
                    -AGAGAGCAGCGTGGAGAGTATCATCTCACCAAAG|GTATGTTTGATGTTTGATGTTGA---------------
                    SEQUENCER02:139:815P4ABXX:5:2206:6232:79610
                    -AGAGAGCAGCGTGGAGAGTATCATCTCACCAAAG|GTATGTTTGATGTTTGATGTTGA---------------
                    SEQUENCER02:139:815P4ABXX:5:2208:21361:143072
                    ---GAGCAGCGTGGAGAGTATCATCTCACCAAAG|GTATGTTTGATGTTGACAT-------------------
                    SEQUENCER02:139:815P4ABXX:5:1207:12944:62989
```

FIGURE 3.85H

```
------GAGCAGCGTGGAGAGTATCATCTCACCAAAG|GTATGTTTGATGTTGACAT------
------SEQUENCER02:139:815P4ABXX:5:2108:21048:196118
------GAGCAGCGTGGAGAGTATCATCTCACCAAAG|GTATGTTTGATGTTGACAT------
------SEQUENCER02:139:815P4ABXX:5:2205:2392:165073
------GAGCAGCGTGGAGAGTATCATCTCACCAAAG|GTATGTTTGATGTTGACAT------
------SEQUENCER02:139:815P4ABXX:5:2206:5915:178327
------GAGCAGCGTGGAGAGTATCATCTCACCAAAG|GTATGTTTGATGTTGACAT------
------SEQUENCER02:139:815P4ABXX:5:2207:3626:132668
------GAGCAGCGTGGAGAGTATCATCTCACCAAAG|GTATGTTTGATGTTGACAT------
------SEQUENCER02:139:815P4ABXX:5:2208:13922:125642
-----AGCAGCGTGGAGAGTATCATCTTACCAAAG|GTATGTTTGATGTTGACATT-----
-----SEQUENCER02:139:815P4ABXX:5:1102:10276:53193
-----AGCAGCGTGGAGAGTATCATCTTACCAAAG|GTATGTTTGATGTTGACATT-----
-----SEQUENCER02:139:815P4ABXX:5:1203:12650:81065
-----AGCAGCGTGGAGAGTATCATCTTACCAAAG|GTATGTTTGATGTTGACATT-----
-----SEQUENCER02:139:815P4ABXX:5:1207:14830:81096
-----AGCAGCGTGGAGAGTATCATCTTACCAAAG|GTATGTTTGATGTTGACATT-----
-----SEQUENCER02:139:815P4ABXX:5:2104:14599:47417
-----AGCAGCGTGGAGAGTATCATCTTACCAAAG|GTATGTTTGATGTTGACATT-----
-----SEQUENCER02:139:815P4ABXX:5:2204:13519:111832
-----AGCAGCGTGGAGAGTATCATCTTACCAAAG|GTATGTTTGATGTTGACATT-----
-----SEQUENCER02:139:815P4ABXX:5:2208:20296:194344
----CAGCGTGGAGAGTATCATCTCACCAAAG|GTATGTTTGATGTTGACATTT----
----SEQUENCER02:139:815P4ABXX:5:1105:15561:105042
----CAGCGTGGAGAGTATCATCTCACCAAAG|GTATGTTTGATGTTGACATTT----
----SEQUENCER02:139:815P4ABXX:5:1106:10371:14549
----CAGCGTGGAGAGTATCATCTCACCAAAG|GTATGTTTGATGTTGACATTT----
----SEQUENCER02:139:815P4ABXX:5:1201:18208:44441
----CAGCGTGGAGAGTATCATCTCACCAAAG|GTATGTTTGATGTTGACATTT----
----SEQUENCER02:139:815P4ABXX:5:1202:20119:129461
----CAGCGTGGAGAGTATCATCTCACCAAAG|GTATGTTTGATGTTGACATTT----
----SEQUENCER02:139:815P4ABXX:5:2105:6455:26681
```

FIGURE 3.85I

```
-------CAGCGTGGAGAGTATCATCTCACCAAAG|GTATGTTTGATGTTTGACATTT-----
   ------SEQUENCER02:139:815P4ABXX:5:2208:9758:195914
   ------GCGTGGAGAGTATCATCTTACCAAAG|GTATGTTTGATGTTTGACATTTTA-
   ------SEQUENCER02:139:815P4ABXX:5:1104:5671:23733
   ------GCGTGGAGAGTATCATCTTACCAAAG|GTATGTTTGATGTTTGACATTTTA-
   ------SEQUENCER02:139:815P4ABXX:5:1204:12993:113705
   ------GCGTGGAGAGTATCATCTTACCAAAG|GTATGTTTGATGTTTGACATTTTA-
   ------SEQUENCER02:139:815P4ABXX:5:1208:14842:42186
   ------GCGTGGAGAGTATCATCTTACCAAAG|GTATGTTTGATGTTTGACATTTTA-
   ------SEQUENCER02:139:815P4ABXX:5:1208:1890:54856
   ------GCGTGGAGAGTATCATCTTACCAAAG|GTATGTTTGATGTTTGACATTTTA-
   ------SEQUENCER02:139:815P4ABXX:5:2106:19153:113967
   ------GCGTGGAGAGTATCATCTTACCAAAG|GTATGTTTGATGTTTGACATTTTA-
   ------SEQUENCER02:139:815P4ABXX:5:2107:18079:200582
   ------GCGTGGAGAGTATCATCTTACCAAAG|GTATGTTTGATGTTTGACATTTTA-
   ------SEQUENCER02:139:815P4ABXX:5:2108:15821:176814
   ------GCGTGGAGAGTATCATCTTACCAAAG|GTATGTTTGATGTTTGACATTTTA-
   ------SEQUENCER02:139:815P4ABXX:5:2201:17735:94979
   ------GCGTGGAGAGTATCATCTTACCAAAG|GTATGTTTGATGTTTGACATTTTA-
   ------SEQUENCER02:139:815P4ABXX:5:2206:11252:52735
   ------GCGTGGAGAGTATCATCTTACCAAAG|GTATGTTTGATGTTTGACATTTTA-
   ------SEQUENCER02:139:815P4ABXX:5:2206:15143:170892
   ------GCGTGGAGAGTATCATCTTACCAAAG|GTATGTTTGATGTTTGACATTTTA-
   ------SEQUENCER02:139:815P4ABXX:5:2206:6662:193619
###########################################################
139TTTAGGC_5  -chr8:117878825_+chr8:124968232   RAD21_FER1L6
  acceptor_genomic_template
***********************************************************
GTCTAAATGACTCAAAGTTTTATTGTTTCTTTTTTTCTTCTTTTCAG|AAAGGGGATGTTTGGGCTGAAGGTGAAGAAGAAGAGAA
ATAAGGCAGAGA  junction_+chr8_124968232_NM_001039112
############

FIGURE 3.85J
```

3.86 ESR1_AKAP12

```
141GCCAAT_8      +chr6:152201906_+chr6:151669846     ESR1_AKAP12    fusion_template
*********************************************************************************************
CCAGGCCTGCCGGCTCCGTAAATGCTACGAAGTGGGAATGATGAAAGGTG|TTGGACAGAGAGACTCTGAAGATGTGAGCAAAAGAGAC
TCCGATAAAGAG  junction_+chr6_152201906_+chr6_151669846_NM_000125_NM_005100
             ------------------------TGGGAATGATGAAAGGTG|TTGGACAGAGAGACTCTGAAGATGTGAGC--------
            SEQUENCER02:141:815YMABXX:8:1107:20955:86322
             ------------------------TGGGAATGATGAAAGGTG|TTGGACAGAGAGACTCTGAAGATGTGAGC--------
            SEQUENCER02:141:815YMABXX:8:1204:13741:185350
             ------------------------TGGGAATGATGAAAGGTG|TTGGACAGAGAGACTCTGAAGATGTGAGC--------
            SEQUENCER02:141:815YMABXX:8:1207:1520:160421
             ------------------------TGGGAATGATGAAAGGTG|TTGGACAGAGAGACTCTGAAGATGTGAGC--------
            SEQUENCER02:141:815YMABXX:8:2103:12485:95344
             ------------------------TGGGAATGATGAAAGGTG|TTGGACAGAGAGACTCTGAAGATGTGAGC--------
            SEQUENCER02:141:815YMABXX:8:2106:8822:106742
             ------------------------TGGGAATGATGAAAGGTG|TTGGACAGAGAGACTCTGAAGATGTGAGC########
##############

141GCCAAT_8      +chr6:152201906_+chr6:151669846     ESR1_AKAP12    donor_template
*********************************************************************************************
CCAGGCCTGCCGGCTCCGTAAATGCTACGAAGTGGGAATGATGAAAGGTG|GGATACGGAAAAGACCGAAGAGAGGGAGAATGTTGAAA
CACAAGCGCCAG  junction_+chr6_152201906_NM_000125
###############################################################################################
##############

141GCCAAT_8      +chr6:152201906_+chr6:151669846     ESR1_AKAP12    acceptor_template
*********************************************************************************************
TCAAGGAGCCCTAAACAGCCAGAGAAGAAGAAGTCATTGTCACAGAGG|TTGGACAGAGAGACTCTGAAGATGTGAGCAAAAGAGAC
TCCGATAAAGAG  junction_+chr6_151627038_+chr6_151669846_NM_005100
###############################################################################################
##############
```

FIGURE 3.86A

```
141GCCAAT_8    +chr6:152201906_+chr6:151669846    ESR1_AKAP12    donor_genomic_template
****************************************************************************************
****************
CCAGGCCTGCCGGCTCCGTAAATGCTACGAAGTGGGAATGATGAAAGGTG|GTAGGTACATCTCTCCCAGGGCCCTTGGGGATGCCC
################################################################################
TGGCCACCGCCC    junction_+chr6_152201906_NM_000125
################
141GCCAAT_8    +chr6:152201906_+chr6:151669846    ESR1_AKAP12
        acceptor_genomic_template
****************************************************************************************
****************
GTAATCACCTTTTCTCTTCTCCCCACCCCCCCCGCCCCTTTTGTTAATAG|TTGGACAGAGAGACTCTGAAGATGTGAGCAAAGAGAC
################################################################################
TCCGATAAAGAG    junction_+chr6_151669846_NM_005100
################
```

FIGURE 3.86B

3.87 PLEKHA8_GNAQ

```
141TTAGGC_5    +chr7:30113748_-chr9:80537261 PLEKHA8_GNAQ    fusion_template
****************************************************************************************
****************
GTAAAACATTGCGGCAACACCATGGCTGGGTAGTTCGAGGGGTTTTGCG|GGACAGGAGAGTGGCAAGAGTACGTTTATCAAGCAG
################################################################################
ATGAGAATCATC    junction_+chr7_30113748_-chr9_80537261_NM_001197026_NM_002072
----------GCTGGGTAGTTCGAGGGGTTTTGCG|GGACAGGAGAGTGGCAAGAGTA----------
################################################################################
        SEQUENCER02:141:815YMABXX:5:1106:14841:64047
----------
################
141TTAGGC_5    +chr7:30113748_-chr9:80537261 PLEKHA8_GNAQ    donor_template
```

FIGURE 3.87A

```
****************************************************************************************
****************
GTAAAACATTGCGGCAACACCATGGCTGGGTAGTTCGAGGGGTTTTTGCG|TTAAGCTTTAAGGGCAGCTCCATCCTATGAAGATTTGT
GGCCGCGTTAAC    junction +chr7_30113748 +chr7_30113748 +chr9_80118206 NM_001197026
###############################################################################
141TTAGGC_5      +chr7:30113748 -chr9:80537261 PLEKHA8_GNAQ    acceptor_template
****************************************************************************************
*******

CCGCAGGACAAGCGGACGCCCGCGGAGCTCAAGCTGCTGCTCG|GGACAGGAGAGTGGCAAGAGTACGTTTATCAAGCAG
ATGAGAATCATC    junction -chr9_80646016 -chr9_80537261 NM_002072
-------------GGGAGCTCAAGCTGCTGCTCG|GGACAGGAGAGTGGCAAGAGTAC-------
-------SEQUENCER02:141:815YMABXX:5:1208:18537:92394

GCTGCTGCTCG|GGACAGGAGAGTGGCAAGAGTACGTTTATCAAGCAGA---------
SEQUENCER02:141:815YMABXX:5:2104:20578:60105
################################################################################
141TTAGGC_5      +chr7:30113748 -chr9:80537261 PLEKHA8_GNAQ    donor_genomic_template
****************************************************************************************
*******

GTAAAACATTGCGGCAACACCATGGCTGGGTAGTTCGAGGGGTTTTGCG|GTAAGTGATCCTTCTGTCCTATTATTAACTGTATT
GGGTATGCCAGT    junction +chr7_30113748 NM_001197026
################################################################################
141TTAGGC_5      +chr7:30113748 -chr9:80537261 PLEKHA8_GNAQ    acceptor_genomic_template
****************************************************************************************
*******

AGACTGAGATGGCACTCTGTCTGATGAGCTGCTATTGTTCATCTTTCAG|GGACAGGAGAGTGGCAAGAGTACGTTTATCAAGCAG
ATGAGAATCATC    junction -chr9_80537261 NM_002072
##############
```

FIGURE 3.87B

3.88 LLGL2_CPNE4

```
141TTAGGC_6       +chr17:73521906_-chr3:131442469      LLGL2_CPNE4     fusion_template
*****************************************************************************************
GGCGCCGAGGACGCCGAGGCCTCGGGCGGGGGCTGGCCCGGGGTTCCAG|GTTGACAGGACTGAGGTGATTCGCACCTGCATAAACCC
AGTGTACTCAAA      junction_+chr17_73521906_-chr3_131442469_NM_004524_NM_130808
------------------GGGGGCTGGCCCGGGGTTCCAG|GTTGACAGGACTGAGGTGATTCGCACCT-------------
##########################################################################################
################
SEQUENCER02:141:815YMABXX:6:1205:13618:3070
141TTAGGC_6       +chr17:73521906_-chr3:131442469      LLGL2_CPNE4     donor_template
*****************************************************************************************
GGCGCCGAGGACGCCGAGGCCTCGGGCGGGGGCTGGCCCGGGGTTCCAG|GTCTCCCAGTGGGGGCTGCAGACTAAGCAAAATGAGGCG
GTTCCTGAGGCC      junction_+chr17_73521906_-chr3_131442469
------------------GGCCCGGGGTTCCAG|GTCTCCCAGTGGGGGCTGCAGACTAAGCAAAATGAG-------
##########################################################################################
SEQUENCER02:141:815YMABXX:6:1101:4740:108290
------------------GGCCCGGGGTTCCAG|GTCTCCCAGTGGGGGCTGCAGACTAAGCAAAATGAG-------############
##########################################################################################
SEQUENCER02:141:815YMABXX:6:2205:18673:108860
141TTAGGC_6       +chr17:73521906_-chr3:131442469      LLGL2_CPNE4     acceptor_template
*****************************************************************************************
CAGACCCCTGTGTCATCCTCAAGATGCAGTCTCATGGGCAGTGGTTTGAG|GTTGACAGGACTGAGGTGATTCGCACCTGCATAAACCC
AGTGTACTCAAA      junction_-chr3_131624108_-chr3_131442469_NM_130808
##########################################################################################
################
141TTAGGC_6       +chr17:73521906_-chr3:131442469      LLGL2_CPNE4     donor_genomic_template
*****************************************************************************************
```

FIGURE 3.88A

```
GGCGCCGAGGGAGGAGCGCCGAGGCCTCGGGCGGGGCTGGCCGGGCTGGCCCGGGGTTCCAG|GTGAGATGCTGCGTGCCGGAGCTCGCCCAGCCGGCCGGCC
CCTCGGGGCTTC    junction_+chr17_73521906_-chr3:131442469_NM_004524          LLGL2_CPNE4
##############################################################**************************************
141TTAGGC_6     +chr17:73521906_-chr3:131442469
*********************                  acceptor_genomic_template
##############
ATAATAAAAATAAATCCTTATCTCTGATAGGTTTTCTCTTTTCTCCTTGCAG|GTTGACAGGACTGAGGTGATTCGCACCTGCATAAACCC
AGTGTACTCAAA    junction_-chr3_131442469_NM_130808
##############################################################**************************************
##############
```

FIGURE 3.88B

3.89 LUC7L3_HNF1B
```
142GCCAAT_7     +chr17:48797192_-chr17:36047395          LUC7L3_HNF1B    fusion_template
***********************************************************************************************
ACCTAGCCCCGACGAGAAGCGCCAGCAACGTGGGTGGACCAACGTGGGACGAGAGC|TGTCCTCTACAAGCCTGGTGATGCCCACACACCACTTA
CTTCGTGCGCAA    junction_+chr17_48797192_-chr17_36047395_NM_006107_NM_000458
---------------------------------CGGTGGGACCACGAGAGC|TGTCCTCTATAAGCCTGGTGATGCCCACACAC--------
                SEQUENCER02:142:815:YGABXX:7:1201:18718:76867
---------------------------------CGGTGGGACCACGAGAGC|TGTCCTCTATAAGCCTGGTGATGCCCACACAC--------
                SEQUENCER02:142:815:YGABXX:7:1201:6241:175663
---------------------------------CGGTGGGACCACGAGAGC|TGTCCTCTATAAGCCTGGTGATGCCCACACAC--------
                SEQUENCER02:142:815:YGABXX:7:2207:5153:98852
CGAGAGC|TGTCCTCTACAAGCCTGGTGATGTCCACACACCACTTACTTCG----------
                SEQUENCER02:142:815:YGABXX:7:1202:14152:189028
##############################################################**************************************
##############
142GCCAAT_7     +chr17:48797192_-chr17:36047395          LUC7L3_HNF1B    donor_template
```

FIGURE 3.89A

```
***********************************************************************************************
**********
ACCTAGCCCCGACGAGAAGCGCAGCAACGTGCGGTGGGACCACGAGAGC|GTTTGTAAATATTATCTCTGTGGTTTTGTCCTGCGGA
ATTGTTCACAAA    junction_+chr17_48797192_+chr17_48814321_NM_006107
-----------    --------TGCCGGTGGGACCACGAGAGC|GTTTGTAAATATTATCTCTGTGGTTTTGT------
-----------    SEQUENCER02:142:815YGABXX:7:2103:19593:50344
-----------    --------TGCCGGTGGGACCACGAGAGC|GTTTGTAAATATTATCTCTGTGGTTTTGT------
-----------    SEQUENCER02:142:815YGABXX:7:2208:9712:24243
-----------    ---------GCGGTGGGACCACGAGAGC|GTTTGTAAATATTATCTCTGTGGTTTTGTC-----
-----------    SEQUENCER02:142:815YGABXX:7:1204:19381:75911
-----------    ---------GCGGTGGGACCACGAGAGC|GTTTGTAAATATTATCTCTGTGGTTTTGTC-----
-----------    SEQUENCER02:142:815YGABXX:7:2101:10270:168035
-----------    ----------GCGGTGGGACCACGAGAGC|GTTTGTAAATATTATCTCTGTGGTTTTGTC----
-----------    SEQUENCER02:142:815YGABXX:7:2108:7930:67763
-----------    ----------GCGGTGGGACCACGAGAGC|GTTTGTAAACATTATCTCTGTGGTTTTGTC----
-----------    SEQUENCER02:142:815YGABXX:7:2203:2850:180882
-----------    -----------GGTGGGACCATGAGAGC|GTTTGTAAATATTATCTCTGTGGTTTTGTCCT---
-----------    SEQUENCER02:142:815YGABXX:7:1205:4193:140818
-----------    -----------GGTGGGACCATGAGAGC|GTTTGTAAATATTATCTCTGTGGTTTTGTCCT---
-----------    SEQUENCER02:142:815YGABXX:7:2207:15403:58410
-----------    -------------GGGACCACGAGAGC|GTTTGTAAATATTATCTCTGTGGTTTTGTCCTGCG--
-----------    SEQUENCER02:142:815YGABXX:7:1203:18696:46996
-----------    -------------GGGACCACGAGAGC|GTTTGTAAATATTATCTCTGTGGTTTTGTCCTGCG--
-----------    SEQUENCER02:142:815YGABXX:7:1207:17974:179488

CACGAGAGC|GTTTGTAAATATTATCTCTGTGGTTTTGTCCTGCGGAATT------
    SEQUENCER02:142:815YGABXX:7:1101:20551:165623

CACGAGAGC|GTTTGTAAATATTATCTCTGTGGTTTTGTCCTGCGGAATT------
    SEQUENCER02:142:815YGABXX:7:1101:4217:48080

CACGAGAGC|GTTTGTAAATATTATCTCTGTGGTTTTGTCCTGCGGAATT------
    SEQUENCER02:142:815YGABXX:7:1207:2345:183809
```

FIGURE 3.89B

FIGURE 3.89C 3.90 TFG_GPR128

```
142GCCAAT_8       +chr3:100438902_+chr3:100348442    TFG_GPR128     fusion_template
***********************************************************************************
CCTTTCCTTTGCAATTCAGTGCAGTAGGATACTGAAACTGACATTATTTG|GAAAATCTACTTCCTCATCAAGCACCCCTACAGAGTTC
TGCAGGAATGGT     junction_+chr3_100438902_+chr3_100348442_NM_006070_NM_032787
-----------------GAAAACTGACATTATTTG|GAAAATCTACTTCCTTATCAAGCACCCCTACAG------
       SEQUENCER02:142:815YGABXX:8:1101:8010:123755
-----------------GAAAACTGACATTATTTG|GAAAATCTACTTCCTTATCAAGCACCCCTACAG------
       SEQUENCER02:142:815YGABXX:8:1104:20921:190919
-----------------GAAAACTGACATTATTTG|GAAAATCTACTTCCTTATCAAGCACCCCTACAG------
       SEQUENCER02:142:815YGABXX:8:1106:20910:120415
##################################################################################

142GCCAAT_8       +chr3:100438902_+chr3:100348442    TFG_GPR128     donor_template
***********************************************************************************
CCTTTCCTTTGCAATTCAGTGCAGTAGGATACTGAAACTGACATTATTTG|TTAATGGCCAGCCAAGACCCCTTGAATCAAGTCAGGTG
AAATATCTCCGT    junction_+chr3_100438902_+chr3_100447556_NM_006070
###################################################################################

142GCCAAT_8       +chr3:100438902_+chr3:100348442    TFG_GPR128    acceptor_template
***********************************************************************************
CATCATTTGGGACTCGGGCATCTGGAGGATTGTGATCAGGATCCAAAGAG|GAAAATCTACTTCCTCATCAAGCACCCCTACAGAGTTC
TGCAGGAATGGT    junction_+chr3_100328815_+chr3_100348442_NM_032787
###################################################################################

142GCCAAT_8       +chr3:100438902_+chr3:100348442    TFG_GPR128    donor_genomic_template
***********************************************************************************
```

FIGURE 3.90A

```
CCTTTCCTTTGCAATTCAGTGCAGTAGGATACTGAAACTGACATTATTTG|GTGAGTAGTAAACTTTCTAATGAATTTACTATTTTATT
CATTGTATTTTA   junction_+chr3_100438902 NM_006070            TFG_GPR128
##############################################################################
142GCCAAT_8    +chr3:100438902_+chr3:100348442
               acceptor_genomic_template
**************************************************************************************
GAAATGAATCAGCCAGTTCATGACTATTCTGTTATTTATTGTTCTTTAG|GAAAATCTACTTCCTCATCAAGCACCCCTACAGAGTTC
TGCAGGAATGGT   junction_+chr3_100348442 NM_032787
##############################################################################
```

FIGURE 3.90B

3.91 MYO18A_SSH2
```
142TTAGGC_4    -chr17:27492960_-chr17:28120955    MYO18A_SSH2  fusion_template
**************************************************************************************
GCAGGAGCTGGCTGCGGAGCGGCCGGAGGACCTCGCAGGAGCCATCCGAT|GAGGCAGCAGCAGTGGGGAGGAAGAATGCCGGTCACAGCC
CAGGAGCATCAG   junction_-chr17_27492960_-chr17_28120955 NM_078471 NM_033389
-----------CGCAGGGAGCCATCCGAT|GAGGCAGCAGCAGTGGGGAGGAAGAATGCCGGTC---------
               SEQUENCER02:142:815YGABXX:4:2103:20524:130650
-----------CGCAGGGAGCCATCCGAT|GAGGCAGCAGCAGTGGGGTGGAAGAATGCCGGTC---------
               SEQUENCER02:142:815YGABXX:4:2204:2763:77999
-----------CGCAGGGAGCCATCCGAT|GAGGCAGCAGCAGTGGGGAGGAAGAATGCCGGTC---------
               SEQUENCER02:142:815YGABXX:4:2204:4505:43721
-----------AGGAGGCAGCCATCCGAT|GAGGCAGCAGCAGTGGGGAGGAAGAATGCCGGTC---------
               SEQUENCER02:142:815YGABXX:4:2207:10444:89272
##############################################################################
142TTAGGC_4    -chr17:27492960_-chr17:28120955    MYO18A_SSH2  donor_template
**************************************************************************************
```

```
         ----GGCTGCGGAGCGGCGGAGGGAGGACCTCGCAGGGAGCCATCCGAT|GTGAGTGCT------------------------
                SEQUENCER02:142:815YGABXX:4:2102:3886:136541
         ----GCGGAGCGGCGGAGGGAGGACCTCGCAGGGAGCCATCCGAT|GTGAGTGCTTCCC-----------------------
                SEQUENCER02:142:815YGABXX:4:1103:18146:100883
         ----GCGGAGCGGCGGAGGGAGGACCTCGCAGGGAGCCATCCGAT|GTGAGTGCTTCCC-----------------------
                SEQUENCER02:142:815YGABXX:4:1205:18200:107231
         ----GCGGAGCGGCGGAGGGAGGACCTCGCAGGGAGCCATCCGAT|GTGAGTGCTTCCC-----------------------
                SEQUENCER02:142:815YGABXX:4:1207:8031:29708
         -------------CGCAGGGAGCCATCCGAT|GTGAGTGCTTCCTTGGGCACCTGGGCTAAGCA-----------------
                SEQUENCER02:142:815YGABXX:4:2101:11836:46021
         ###############################################################################
142TTAGGC_4     -chr17:27492960_-chr17:28120955    MYO18A_SSH2
         acceptor_genomic_template
         *************************************
GATATGAAACCTCAGGTTTTAATTTTTTTTTCATTTTCTGTCTATACAG|GAGGCAGACAGTGGGGAGGAAGAATGCCGGTCACAGCC
CAGGAGGTATGT  junction -chr17_28120955_NM_033389
         ###############################################################################
         ###############

FIGURE 3.91C 3.92 TFG_GPR128
142TTAGGC_7    +chr3:100438902_+chr3:100348442    TFG_GPR128   fusion_template
         ********************************************************************************
CCTTTCCTTTGCAATTCAGTGCAGTAGATACTGAAACTGACATTATTTG|GAAAATCTACTTCCTCATCAAGCACCCTACAGAGTTC
TGCAGGAATGGT  junction +chr3_100438902_+chr3_100348442_NM_006070_NM_032787
         -------------GAAACTGACATTATTTG|GAAAATCTACTTCCTCATCAAGCACCCCTACAG-----
                SEQUENCER02:142:815YGABXX:7:1207:13583:64564
         ###############################################################################
         ##############
142TTAGGC_7    +chr3:100438902_+chr3:100348442    TFG_GPR128   donor_template
         ********************************************************************************

FIGURE 3.92A
```

```
********************************************
****************************
CCTTTCCTTTGCAATTCAGTGCAGTAGGATACTGAAACTGACATTATTTG|TTAATGGCCAGCCAAGACCCCTTGAATCAAGTCAGGTG
AAATATCTCCGT   junction_+chr3_100438902_+chr3_100447556_NM_006070
############################################
##########
142TTAGGC_7    +chr3:100438902_+chr3:100348442    TFG_GPR128   acceptor_template
********************************************
**************
CATCATTTTGGGACTGGGCATCTGGAGGATTGTGATCAGGATCCAAAGAG|GAAAATCTACTTCCTCATCAAGCACCCCTACAGAGTTC
TGCAGGAATGGT   junction_+chr3_100328815_+chr3_100348442_NM_032787
############################################
##########
142TTAGGC_7    +chr3:100438902_+chr3:100348442    TFG_GPR128   donor_genomic_template
********************************************
***********
CCTTTCCTTTGCAATTCAGTGCAGTAGGATACTGAAACTGACATTATTTG|GTGAGTAGTAAACTTTCTAATGAATTACTATTTTATT
CATTGTATTTTA   junction_+chr3_100438902_NM_006070
############################################

142TTAGGC_7    +chr3:100438902_+chr3:100348442    TFG_GPR128
          acceptor_genomic_template
********************************************
************
GAAATGAATCAGCCAGTTCATGACTATTCTGTTATTATTGTTTCTTTAG|GAAAATCTACTTCCTCATCAAGCACCCCTACAGAGTTC
TGCAGGAATGGT   junction_+chr3_100348442_NM_032787
############################################
########
```

```
CGCCGCCGCCGCTCCGCCATGGGGAAGCGACAGCAGCACCAAAAGGACAAAAT|GTAAGTTGAGCCGCAGTCGGGAGCGGCGCTCCACTCTG
CCTCAGTGAACC     junction +chr22_22020420 NM_014337
##############################################################################################
145GCCAAT_3      +chr22:22020420 +chr22:30064322      PPIL2_NF2 acceptor_genomic_template
******************************************************************************************
                                                        *******
TGAAGTAAATTGTGGATATTAACCTTTTTGTCTGCTTCGTGTGGCCACAG|ATTCTCCAGCTATGTATCGGAACCATGATCTATTTAT
GAGGAGAAGGAA     junction +chr22_30064322 NM_000268
##############################################################################################
GGCCACAG|ATTCTCCAGCTATGTATCGGGAACCATGATCTATTTATGAGG---------
       SEQUENCER02:145:815YHABXX:3:2207:6884:58523
##############################################################################################
##############
```

FIGURE 3.93B

3.94 ADAM9_ANK1
```
145TTAGGC_1      +chr8:38883403_-chr8:415855524 ADAM9_ANK1        fusion_template
**********************************************************************************************
CATTTGTGGGAACAGTGTGTTCAAGGAGCCACGCAGGCGGATTAATGTG|AAGGGAACACGGCCCTGCACATCGCTGCTCTAGCCGG
GCAGGATGAGGT     junction +chr8_38883403_-chr8_41585524 NM_003816 NM_000037
                        --CGCAGGCGGATTAATGTG|AAGGGAACACGGCCCTGCACATCGCTGCTC--------
                         SEQUENCER02:145:815YHABXX:1:1103:8331:176269
                        --CGCAGGCGGATTAATGTG|AAGGGAACACGGCCCTGCACATCGCTGCTC--------
                         SEQUENCER02:145:815YHABXX:1:1106:2095:178173
                        --CGCAGGCGGATTAATGTG|AAGGGAACACGGCCCTGCACATCGCTGCTC--------
                         SEQUENCER02:145:815YHABXX:1:1202:16945:101771
                        --CGCAGGCGGATTAATGTG|AAGGGAACACGGCCCTGCACATCGCTGCTC--------
                         SEQUENCER02:145:815YHABXX:1:1208:9971:153967
                        --CGCAGGCGGATTAATGTG|AAGGGAACACGGCCCTGCACATCGCTGCTC--------
                         SEQUENCER02:145:815YHABXX:1:2102:5030:183679
```

```
----------------------------------SEQUENCER02:145:815YHABXX:1:1103:17582:103729
---------------------------------GCAGGCGGGATTAATGTG|TTTGGACAAATCACTGTGGAGACATTGCTTC----
--------------------------------SEQUENCER02:145:815YHABXX:1:1207:19020:73323
-------------------------------GCAGGCGGGATTAATGTG|TTTGGACAAATCACTGTGGAGACATTGCTTC----
------------------------------SEQUENCER02:145:815YHABXX:1:2102:9200:117123
-----------------------------GCAGGCGGGATTAATGTG|TTTGGACAAATCACTGTGGAGACATTGCTTC----
----------------------------SEQUENCER02:145:815YHABXX:1:2103:4547:180791
---------------------------GCAGGCGGGATTAATGTG|TTTGGACAAATCACTGTGGAGACATTGCTTC----
--------------------------SEQUENCER02:145:815YHABXX:1:2107:6043:169011
-------------------------GCAGGCGGGATTAATGTG|TTTGGACAAATCACTGTGGAGACATTGCTTC----
------------------------SEQUENCER02:145:815YHABXX:1:2202:9051:100852
-----------------------CAGGCGGGATTAATGTG|TTTGGACAAATCACTGTGGAGACATTGCTTC----
----------------------SEQUENCER02:145:815YHABXX:1:1206:7536:106664
---------------------CAGGCGGGATTAATGTG|TTTGGACAAATCACTGTGGAGACATTGCTTC----
--------------------SEQUENCER02:145:815YHABXX:1:2101:19029:103191
-------------------CAGGCGGGATTAATGTG|TTTGGACAAATCACTGTGGAGACATTGCTTC----
------------------SEQUENCER02:145:815YHABXX:1:2103:11866:183386
-----------------CAGGCGGGATTAATGTG|TTTGGACAAATCACTGTGGAGACATTGCTTCC----
----------------SEQUENCER02:145:815YHABXX:1:2105:10807:197898
---------------CAGGCGGGATTAATGTG|TTTGGACAAATCACTGTGGAGACATTGCTTCC----
--------------SEQUENCER02:145:815YHABXX:1:2105:1316:21352
-------------CAGGCGGGATTAATGTG|TTTGGACAAATCACTGTGGAGACATTGCTTCC----
------------SEQUENCER02:145:815YHABXX:1:2202:9203:100244
-----------CAGGCGGGATTAATGTG|TTTGGACAAATCACTGTGGAGACATTGCTTCC----
----------SEQUENCER02:145:815YHABXX:1:2203:10550:44189
---------CAGGCGGGATTAATGTG|TTTGGACAAATCACTGTGGAGACATTGCTTCC----
--------SEQUENCER02:145:815YHABXX:1:2203:1397:29486
-------CAGGCGGGATTAATGTG|TTTGGACAAATCACTGTGGAGACATTGCTTCC----
------SEQUENCER02:145:815YHABXX:1:2205:11199:193455
-----GCGGGATTAATGTG|TTTGGACAAATCACTGTGGAGACATTGCTTCC----
----SEQUENCER02:145:815YHABXX:1:1103:11771:175488
---GCGGGATTAATGTG|TTTGGACAAATCACTGTGGAGACATTGCTTCCAT---
```

FIGURE 3.94C

```
SEQUENCER02:145:815YHABXX:1:1205:20696:177411    ------GCGGGATTAATGTG|TTTGGACAAATCACTGTGGAGACATTTGCTTCCAT---
SEQUENCER02:145:815YHABXX:1:1208:6590:157747     ------GCGGGATTAATGTG|TTTGGACAAATCACTGTGGAGACATTTGCTTCCAT---
SEQUENCER02:145:815YHABXX:1:2202:10124:191137    ------GCGGGATTAATGTG|TTTGGACAAATCACTGTGGAGACATTTGCTTCCAT---
SEQUENCER02:145:815YHABXX:1:1101:3711:165519     ------CGGGGATTAATGTG|TTTGGACAAATCACTGTGGAGACATTTGCTTCCATTG-
SEQUENCER02:145:815YHABXX:1:1102:7729:38367      ------CGGGGATTAATGTG|TTTGGACAAATCACTGTGGAGACATTTGCTTCCATTG-
SEQUENCER02:145:815YHABXX:1:1103:12016:56644     ------CGGGGATTAATGTG|TTTGGACAAATCACTGTGGAGACATTTGCTTCCATTG-
SEQUENCER02:145:815YHABXX:1:1104:2072:51056      ------CGGGGATTAATGTG|TTTGGACAAATCACTGTGGAGACATTTGCTTCCATTG-
SEQUENCER02:145:815YHABXX:1:1105:7056:167926     ------CGGGGATTAATGTG|TTTGGACAAATCACTGTGGAGACATTTGCTTCCATTG-
SEQUENCER02:145:815YHABXX:1:1108:2175:132985     ------CGGGGATTAATGTG|TTTGGACAAATCACTGTGGAGACATTTGCTTCCATTG-
SEQUENCER02:145:815YHABXX:1:1108:4753:94470      ------CGGGGATTAATGTG|TTTGGACAAATCACTGTGGAGACATTTGCTTCCATTG-
SEQUENCER02:145:815YHABXX:1:1207:11119:4856      ------CGGGGATTAATGTG|TTTGGACAAATCACTGTGGAGACATTTGCTTCCATTG-
SEQUENCER02:145:815YHABXX:1:2101:3699:75968      ------CGGGGATTAATGTG|TTTGGACAAATCACTGTGGAGACATTTGCTTCCATTG-
SEQUENCER02:145:815YHABXX:1:2107:13298:145090    ------CGGGGATTAATGTG|TTTGGACAAATCACTGTGGAGACATTTGCTTCCATTG-
SEQUENCER02:145:815YHABXX:1:2108:10783:24921     ------CGGGGATTAATGTG|TTTGGACAAATCACTGTGGAGACATTTGCTTCCATTG-
SEQUENCER02:145:815YHABXX:1:2108:15865:5403      ------CGGGGATTAATGTG|TTTGGACAAATCACTGTGGAGACATTTGCTTCCATTG-
SEQUENCER02:145:815YHABXX:1:2108:19635:89387     ------CGGGGATTAATGTG|TTTGGACAAATCACTGTGGAGACATTTGCTTCCATTG-
```

3.95 LRP8_TMEM48

```
145TTAGGC_3       -chr1:53746259_-chr1:54275419 LRP8_TMEM48       fusion_template
****************************************************************************************
****************
CGGGGAGAAGGACTGCCGAGGTGGAGCGGATGAGGCCGGCTGTGCTACCT|GCTATATATTCCCAAAGCTTGGATTAGCACTGCTATGAAC
CTTCACATAGAT     junction -chr1_53746259_-chr1_54275419_NM_004631_NM_018087
-------------CGAGGTGGAGCGGATGAGGCCGGCTGTGCTACCT|GCTATATTCCCAAAG-----------------------
                 SEQUENCER02:145:815YHABXX:3:2206:7682:65541
--------------CCGGCTGTGCTACCT|GCTATATTCCCAAAGCTTGGATTAGCACTGCTATG---
                 SEQUENCER02:145:815YHABXX:3:1201:3247:164565
##########################################################################################
############
145TTAGGC_3       -chr1:53746259_-chr1:54275419 LRP8_TMEM48       donor_template
****************************************************************************************
***************
CGGGGAGAAGGACTGCCGAGGTGGAGCGGATGAGGCCGGCTGTGCTACCT|TGTGCGCCCGCACGAGTTCCAGTGCGGCAACCGCTCG
TGCCTGGCCGCC     junction_-chr1_53746259_-chr1_53742750_NM_004631
##########################################################################################
############
145TTAGGC_3       -chr1:53746259_-chr1:54275419 LRP8_TMEM48       acceptor_template
****************************************************************************************
***************
GGAATCACTGTTCCTGGTTAGAAATTTCTGCATTTTATATTATTTCTTG|GCTATATTCCCAAAGCTTGGATTAGCACTGCTATGAAC
CTTCACATAGAT     junction_-chr1_54284644_-chr1_54275419_NM_018087
----------CCTGGTTAGAAATTTCTGCATTTTATATTATTTTCTTG|GCTATAATCCCA----------------
                 SEQUENCER02:145:815YHABXX:3:2104:11167:57727
----------CCTGGTTAGAAATTTCTGCATTTTATATTATTTCTTG|GCTATAATCCCA-----
                 SEQUENCER02:145:815YHABXX:3:2107:7857:84265
##########################################################################################
############
145TTAGGC_3       -chr1:53746259_-chr1:54275419 LRP8_TMEM48       donor_genomic_template
****************************************************************************************
***************
```

FIGURE 3.95A

```
CGGGGAGAAGGACTGCGAGGTGGAGGGTGGAGCGGATGAGGCCGGCTGTGCTACCT|GTGAGTCTCGGGGTCAGATCTCCAGGGTCTGCCAAGCAT
GGTCAGGCAGCC  junction_-chr1_53746259_NM_004631
                 ###############################################################################
GTGCTACCT|GTGAGTCTCGGGGTCAGATCTCCAGGGTCTGCCAAGCATGGT------
     SEQUENCER02:145:815YHABXX:3:1104:11178:45022
#########################################################################################
145TTAGGC_3   -chr1:53746259_-chr1:54275419_LRP8_TMEM48   acceptor_genomic_template
**************************************************************************************
ACTTGTTTTATAACTTTTTATGTTCATAGCTTGGTATTTTTCCCTTCAG|GCTATATTCCCAAAGCTTGGATTAGCACTGCTATGAAAC
CTTCACATAGAT  junction_-chr1_54275419_NM_018087
                ##############################################################################

FIGURE 3.95B 3.96 TRIM37_BCAS3
145TTAGGC_3  -chr17:57092971_+chr17:58786580   TRIM37_BCAS3   fusion_template
***********************************************************************************
TTCAGTGGCTTGCCTGCGTTGAGAAAAGGAGGAAAATGGTCACCTTGGG|ATACATCAAGAAATCTGGAATTTCATGAAATACATAGT
ACTGGGAATGAA  junction_-chr17_57092971_+chr17_58786580_NM_015294_NM_017679
************************************************------
-------------GGCTTGCCTGCGTTGAGAAAAGGAGGAAAATGGTCACCTTGGG|ATACAT---
     SEQUENCER02:145:815YHABXX:3:2106:8101:19768
-------------GGCTTGCCTGCGTTGAGAAAAGGAGGAAAATGGTCACCTTGGG|ATACA----
     SEQUENCER02:145:815YHABXX:3:2206:5833:73456
----------TGCCTGCGTTGAGAAAAGGAGGAAAATGGTCACCTTGGG|ATACATCAAG------
     SEQUENCER02:145:815YHABXX:3:1102:17247:142030
-------------GGCTTGCCTGCGTTGAGAAAAGGAGGAAAATGGTCACCTTGGG|ATACA----
     SEQUENCER02:145:815YHABXX:3:1103:4557:44425
----------TGCCTGCGTTGAGAAAAGGAGGAAAATGGTCACCTTGGG|ATACATCAAG------
     SEQUENCER02:145:815YHABXX:3:1202:5224:156382
```

FIGURE 3.96A

```
                                                                                        TGCCTGCGGGTTGAGAAAAGGAGGAAAATGGTCACCTTGGG|ATACATCAAG----------------------------
                                                                               SEQUENCER02:145:815YHABXX:3:1204:10364:171001
                                                                                        TGCCTGCGGGTTGAGAAAAGGAGGAAAATGGTCACCTTGGG|ATACATCAAG----------------------------
                                                                               SEQUENCER02:145:815YHABXX:3:1206:14901:134348
                                                                                        TGCCTGCGGGTTGAGAAAAGGAGGAAAATGGTCACCTTGGG|ATACATCAAG----------------------------
                                                                               SEQUENCER02:145:815YHABXX:3:1206:4354:48483
                                                                                        TGCCTGCGGGTTGAGAAAAGGAGGAAAATGGTCACCTTGGG|ATACATCAAG----------------------------
                                                                               SEQUENCER02:145:815YHABXX:3:1206:7542:174355
                                                                                        TGCCTGCGGGTTGAGAAAAGGAGGAAAATGGTCACCTTGGG|ATACATCAAG----------------------------
                                                                               SEQUENCER02:145:815YHABXX:3:2103:16736:130017
                                                                                        TGCCTGCGGGTTGAGAAAAGGAGGAAAATGGTCACCTTGGG|ATACATCAAG----------------------------
                                                                               SEQUENCER02:145:815YHABXX:3:2205:9318:4464
                                                                                        TGCCTGCGGGTTGAGAAAAGGAGGAAAATGGTCACCTTGGG|ATACATCA--------------------------------
                                                                               SEQUENCER02:145:815YHABXX:3:2208:12814:189241
                                                                                       GCCTGCGGGTTGAGAAAAGGAGGAAAATGGTCACCTTGGG|ATACATCAAG----------------------------
                                                                               SEQUENCER02:145:815YHABXX:3:2106:13013:48863
                                                                                    GCGGTTGAGAAAAGGAGGAAAATGGTCACCTTGGG|ATACATCAAGAAATC-----------------------
                                                                               SEQUENCER02:145:815YHABXX:3:1206:11031:33526
                                                                              ---------GAGGAAAATGGTCACCTTGGG|ATACATCAAGAAATCTGGAATTCATGA------------
                                                                               SEQUENCER02:145:815YHABXX:3:1101:1415:132254
                                                                              ---------GAGGAAAATGGTCACCTTGGG|ATACATCAAGAAATCTGGAATTCATGA------------
                                                                               SEQUENCER02:145:815YHABXX:3:1208:10381:105811
                                                                              ---------GAGGAAAATGGTCACCTTGGG|ATACATCAAGAAATCTGGAATTCATGA------------
                                                                               SEQUENCER02:145:815YHABXX:3:2208:9629:180097
GGTCACCTTGGG|ATACATCAAGAAATCTGGAATTCATGAAATACATAGT------------------
                SEQUENCER02:145:815YHABXX:3:1201:20131:177600
GGTCACCTTGGG|ATACATCAAGAAATCTGGAATTCATGAAATACATAGT------------------
                SEQUENCER02:145:815YHABXX:3:2101:11297:51488
###############################################################
145TTAGGC_3      -chr17:57092971_+chr17:58786580    TRIM37_BCAS3    donor_template
```

FIGURE 3.96B

```
************************************************************
****************
TTCAGTGGCTTGCCTGCGGTTGAGAAAGGAGGAAAATGGTCACCTTGGG|GGCTAATGCTAAAGGAGGTCATCTGAAGGACTGCAGA
TGACTGATTTGG   junction -chr17:57092971_-chr17:57089807 NM_015294     TRIM37_BCAS3   acceptor_template
############################################################
###########
145TTAGGC_3    -chr17:57092971_+chr17:58786580     TRIM37_BCAS3   acceptor_template
************************************************************
*********

AGAAAAGGAGAAAATAGTCTGGGTCAGATTTGAAAAATGCAGATTTAAATG|ATACATCAAGAAATCTGGAATTTCATGAAATACATAGT
ACTGGGAATGAA   junction_+chr17_58767122_+chr17_58786580_NM_017679
############################################################
##########
145TTAGGC_3    -chr17:57092971_+chr17:58786580     TRIM37_BCAS3   donor_genomic_template
************************************************************
*********

TTCAGTGGCTTGCCTGCGGTTGAGAAAGGAGGAAAATGGTCACCTTGGG|GTAAATTAAGTTGTTTTGTATATGTAATGGTATAATAG
CTAATAGCTTTG   junction -chr17:57092971 NM_015294     TRIM37_BCAS3
############################################################
#######
145TTAGGC_3    -chr17:57092971_+chr17:58786580     TRIM37_BCAS3
acceptor_genomic_template
************************************************************
*********

TGCCATTATGTCTCTTTTAAATTTGCTTCTTTGTACTTAATTCTAATGCAG|ATACATCAAGAAATCTGGAATTTCATGAAATACATAGT
ACTGGGAATGAA   junction_+chr17_58786580_NM_017679
############################################################
########

FIGURE 3.96C 3.97 TRIM37_BCAS3
145TTAGGC_3    -chr17:57094657_+chr17:58786580     TRIM37_BCAS3   fusion_template

FIGURE 3.97A
```

```
CCCTGGAGAAATAGTCGTTCAAAGGGAGACTGTCAGACTCTGTCTGAAAG|GTAAAATTTGAGGGATTCAGAATGTACTTTTAGTGGGGT
AAATATTTATTA   junction_-chr17_57094657_NM_015294            TRIM37_BCAS3
###############################################################################################
145TTAGGC_3    -chr17:57094657_+chr17:58786580      TRIM37_BCAS3
    acceptor_genomic_template
***********************************************************************************************
TGCCATTATGTCTTTTAAAATTGCTTCTTTGTTACTTAATTCTAATGCAG|ATACATCAAGAAATCTGGAATTTCATGAAATACATAGT
ACTGGGAATGAA   junction_+chr17_58786580_NM_017679
###############################################################################
```

FIGURE 3.97B

3.98 APPBP2_KIF19
```
145TTAGGC_5    -chr17:58577760_+chr17:72345323     APPBP2_KIF19   fusion_template
***********************************************************************************************
TTTTGTGAATTGGAAGTTTTTGCTAAAGTACTGAGAGCTTTGGATAAAAG|GTGAAGCAGAACCTCCTGAACGTCTCCTACCACATCGC
CCAGTACACCAG   junction_-chr17_58577760_+chr17_72345323_NM_006380_NM_153209
***********************************************************************************************
                                                 -GAGAGCTTTGGATAAAAG|GTGAAGCAGAATCTCCTGAACGTCTCCTACCA------
    SEQUENCER02:145:815YHABXX:5:1104:9938:127819
###############################################################################################
145TTAGGC_5    -chr17:58577760_+chr17:72345323     APPBP2_KIF19   donor_template
***********************************************************************************************
TTTTGTGAATTGGAAGTTTTTGCTAAAGTACTGAGAGCTTTGGATAAAAG|ACATTGCTTCATCATTGTTTTCAGGCTTTGATGGATC
ATGGTGTTAAAG   junction_-chr17_58577760_-chr17_58571978_NM_006380
***********************************************************************************************
                 SEQUENCER02:145:1202:17183:157286
                                                 -GAGAGCTTTGGATAAAAG|ACATTGCTTCATCATTGTTTTCAGGCTTTGA------
    SEQUENCER02:145:815YHABXX:5:1205:7508:12010
```

```
GTGCACCTGGGGTGACTGCATCCCCTCCGCTCCATACGTGTTCCCTGCAG|GTGAAGCAGAACCTCCTGAACGTCTCCTACCACATCGC
CCAGTACACCAG    junction_+chr17_72345323_NM_153209    ##################################
#######################
```

FIGURE 3.98C

```
3.99 SEMA4C_BRE
145TTAGGC_5       -chr2:97527316_+chr2:28561317_SEMA4C_BRE    fusion_template
*************************************************************************************
GATGACCTCGGACACTTCAGGCATCTGCAACCTCCGTGGCAGTAAGAAAG|GCTTATTTCAAAACCTTTGTCCCTCAGTTCCAGGAGG
CAGCATTTGCCA   junction_-chr2_97527316_+chr2_28561317_NM_017789_NM_004899
-------CGGACACTTCAGGCATCTGCAACCTCCGTGGCAGTAAGAAAG|GCTTATT-------------------------------
----------SEQUENCER02:145:815YHABXX:5:1101:15719:172659
----------CGGACACTTCAGGCATCTGCAACCTCCGTGGCAGTAAGAAAG|GCTTATT-------------------------------
----------SEQUENCER02:145:815YHABXX:5:1108:2165:2847
----------CGGACACTTCAGGCATCTGCAACCTCCGTGGCAGTAAGAAAG|GCTTAT--------------------------------
----------SEQUENCER02:145:815YHABXX:5:1201:1517:21432
----------CGGACACTTCAGGCATCTGCAACCTCCGTGGCAGTAAGAAAG|GCTTATT-------------------------------
----------SEQUENCER02:145:815YHABXX:5:1205:14854:137666
----------CGGACACTTCAGGCATCTGCAACCTCCGTGGCAGTAAGAAAG|GCTTATT-------------------------------
----------SEQUENCER02:145:815YHABXX:5:1206:12452:83759
---------------CCGTGGCAGTAAGAAAG|GCTTATTTCAAAACCTTTGTCCCTCAGTTCCA---
----------SEQUENCER02:145:815YHABXX:5:1101:10088:81951
---------------CCGTGGCAGTAAGAAAG|GCTTATTTCAAAACCTTTGTCCCTCAGTTCCA---
----------SEQUENCER02:145:815YHABXX:5:1102:4809:162812
---------------CCGTGGCAGTAAGAAAG|GCTTATTTCAAAACCTTTGTCCCTCAGTT------
----------SEQUENCER02:145:815YHABXX:5:1103:12131:184273
---------------CCGTGGCAGTAAGAAAG|GCTTATTTCAAAACCTTTGTCCCTCAGTTCCA---
----------SEQUENCER02:145:815YHABXX:5:1103:15879:70699
---------------CCGTGGCAGTAAGAAAG|GCTTATTCCAAAACCTTTGTCCCTCAGTTCCA---
----------SEQUENCER02:145:815YHABXX:5:1106:11478:70954
```

FIGURE 3.99A

```
------------|SEQUENCER02:145:815YHABXX:5:1106:15828:68880   |-------CCGTGGCAGTAAGAAAG|GGCTTATTTCAAAAACCTTTGTCCCTCAGTTCCA------
------------|SEQUENCER02:145:815YHABXX:5:1106:16832:86023   |----CCGTGGCAGTAAGAAAG|GGCTTATTTCAAAAACCTTTGTCCCTCAGTTCCA------
------------|SEQUENCER02:145:815YHABXX:5:1207:14664:80023   |----CCGTGGCAGTAAGAAAG|GGCTTATTTCAAAAACCTTTGTCCCTCAGTTCCA------
------------|SEQUENCER02:145:815YHABXX:5:1207:3181:111747   |----CCGTGGCAGTAAGAAAG|GGCTTATTTCAAAAACCTTTGTCCCTCAGTTCCA------
------------|SEQUENCER02:145:815YHABXX:5:2101:4507:62386    |----CCGTGGCAGTAAGAAAG|GGCTTATTTCAAAAACCTTTGTCCCTCAGTTCCA------
------------|SEQUENCER02:145:815YHABXX:5:2103:9849:132126   |----CCGTGGCAGTAAGAAAG|GGCTTATTTCAAAAACCTTTGTCCCTCAGTT--------
------------|SEQUENCER02:145:815YHABXX:5:2108:6307:5107     |----CCGTGGCAGTAAGAAAG|GGCTTATTTCAAAAACCTTTGTCCCTCAGTT--------
------------|SEQUENCER02:145:815YHABXX:5:2201:10430:88619   |--GTGGCAGTAAGAAAG|GGCTTATTTCAAAAACCTTTGTCCCTCAGTTCCAGG----
------------|SEQUENCER02:145:815YHABXX:5:1103:9345:172740   |-TGGCAGTAAGAAAG|GGCTTATTTCAAAAACCTTTGTCCCTCAGTTCCAGGA---
------------|SEQUENCER02:145:815YHABXX:5:1105:15445:64698   |-TGGCAGTAAGAAAG|GGCTTATTTCAAAAACCTTTGTCCCTTAGTTCCAGGA---
------------|SEQUENCER02:145:815YHABXX:5:1207:1885:101479   |-TGGCAGTAAGAAAG|GGCTTATTTCAAAAACCTTTGTCCCTCAGTTCCAGGA---
------------|SEQUENCER02:145:815YHABXX:5:2102:13344:165767  |-TGGCAGTAAGAAAG|GGCTTATTTCAAAAACCTTTGTCCCTCAGTTCCAGGA---
------------|SEQUENCER02:145:815YHABXX:5:2103:10969:175517  |-TGGCAGTAAGAAAG|GGCTTATTTCAAAAACCTTTGTCCCTCAGTTCCAGGA---
------------|SEQUENCER02:145:815YHABXX:5:2201:5653:118562   |-TGGCAGTAAGAAAG|GGCTTATTTCAAAAACCTTTGTCTCTCAGTTCCAGGA---
------------|SEQUENCER02:145:815YHABXX:5:1205:6375:75186    |-GGCAGTAAGAAAG|GGCTTATTTCAAAAACCTTTGTCTCTCAGTTCCAGGAG--
------------|SEQUENCER02:145:815YHABXX:5:2105:12762:105136  |-GGCAGTAAGAAAG|GGCTTATTTCAAAAACCTTTGTCCCTCAGTTCCAGGAG--
```

FIGURE 3.99B

```
###############################################################################
#####
145TTAGGC_5       -chr2:97527316_+chr2:28561317_SEMA4C_BRE      donor_template
**********************************************************************
GATGACCTCGGACACTTCAGGCATCTGCAACCTCCGTGGCAGTAAGAAAG|TCAGGCCCACTCCCAAAAACATCACGGTGTGGCGGGC
ACAGACCTGGTG  junction_-chr2_97527316_-chr2_97527192_NM_017789
------------------CCGTGGCGGTAAGAAAG|TCAGGCCCACTCCCAAAAACATCACGGTGTGG------
       SEQUENCER02:145:815YHABXX:5:1203:12812:83862
------------------GTGGCAGTAAGAAAG|TCAGGCCCGCTCCCAAAACATCACGGTGTGGCG------
       SEQUENCER02:145:815YHABXX:5:2104:13416:58790
###############################################################################
#####
145TTAGGC_5       -chr2:97527316_+chr2:28561317_SEMA4C_BRE      acceptor_template
**********************************************************************
TGGAGGGCCTCAGAGGGAGAGAGAACTGCTCAGTAATTTTGATCACTTTG|GGCTTATTTCAAAACCTTTGTCCCTCAGTTCCAGGAGG
CAGCATTTGCCA  junction_+chr2_28550314_+chr2_28561317_NM_004899
###############################################################################
#####
145TTAGGC_5       -chr2:97527316_+chr2:28561317_SEMA4C_BRE      donor_genomic_template
**********************************************************************
GATGACCTCGGACACTTCAGGCATCTGCAACCTCCGTGGCAGTAAGAAAG|GTGAGCTTTTTCATTCCCGTCGCATCGGGCTGAGCCCT
GGACCAGAGCTG  junction_-chr2_97527316_NM_017789
------------------CCGTGGCAGTAAGAAAG|GTGAGCTTTTTCATTCCCGTCGCATCGGGCTGA------
       SEQUENCER02:145:815YHABXX:5:2107:9291:61284
------------------CCGTGGCAGTAAGAAAG|GTGAGCTTTTTCATTCCCGTCGCATCGGGCTGA------
       SEQUENCER02:145:815YHABXX:5:2202:16086:3268
AGTAAGAAAG|GTGAGCTTTTTCATTCCCGTCGCATCGGGCTGAGCCCTGG------
       SEQUENCER02:145:815YHABXX:5:2107:5013:30804
```

FIGURE 3.99C

```
AAGAAAAG|GTGAGCTTTTTCATTCCCGTCGCATCGGGTTGAGCCCTGGACC------
         SEQUENCER02:145:815YHABXX:5:1205:11322:78986
         -----------------------------------------------
AAGAAAAG|GTGAGCTTTTTCATTCCCGTCGCATCGGGTTGAGCCCTGGACC------
         SEQUENCER02:145:815YHABXX:5:1208:9752:88290
         -----------------------------------------------
AAGAAAAG|GTGAGCTTTTTCATTCCCGTCGCATCGGGTTGAGCCCTGGACC------
         SEQUENCER02:145:815YHABXX:5:2106:5504:86113
##########################################################
145TTAGGC_5   -chr2:97527316_+chr2:28561317 SEMA4C_BRE   acceptor_genomic_template
**********************************************************
AAGTTGTTGTGCTAACCACAATTTTTTTCTCCCCTTCTTTCCACCAG|GGCTTATTTCAAAACCTTTGTCCCTCAGTTCCAGGAGG
CAGCATTTGCCA     junction_+chr2_28561317_NM_004899
##########################################################
##########

FIGURE 3.99D 3.100 TFG_GPR128
145TTAGGC_5   +chr3:100438902_+chr3:100348442    TFG_GPR128    fusion_template
**********************************************************************************
CCTTTCCTTTGCAATTCAGTGCAGTAGGATACTGAAACTGACATTATTTG|GAAAATCTACTTCCTCATCAAGCACCCCTACAGAGTTC
TGCAGGAATGGT    junction_+chr3_100438902_+chr3_100348442_NM_006070_NM_032787
                --------------------------------------------------------------
                -AGTAGGATACTGAAACTGACATTATTTG|GAAAATCTACTTCCTCATCAAG----------
                SEQUENCER02:145:815YHABXX:5:1207:11265:105588
                --------------------------------------------------------------
                -AGTAGGATACTGAAACTGACATTATTTG|GAAAATCTACTTCCTCATCAAG----------
                SEQUENCER02:145:815YHABXX:5:2206:17881:45018
                --------------------------------------------------------------
                -AGGATACTGAAACTGACATTATTTG|GAAAATCTACTTCCTCATCAAGCAC----------
                SEQUENCER02:145:815YHABXX:5:1102:8446:21511

FIGURE 3.100A
```

```
##################################################################
##########
145TTAGGC_5     +chr3:100438902_+chr3:100348442     TFG_GPR128    donor_template
****************************************************************
**********
CCTTTCCTTTGCAATTCAGTGCAGTAGGATACTGAAACTGACATTATTTG|TTAATGGCCAGCCAAGACCCCTTGAATCAAGTCAGGTG
AAATATCTCCGT    junction_+chr3_100438902_+chr3_100438902_NM_006070
-----------------AGTGCAGTAGGATACTGAAACTGACATTATTTG|TTAATGGCCAGCCAAGA---------------------
                 SEQUENCER02:145:815YHABXX:5:2201:2753:100596
-----------------AGTGCAGTAGGATACTGAAACTGACATTATTTG|TTAATGGCCAGCCAAGA---------------------
                 SEQUENCER02:145:815YHABXX:5:2201:4769:161895
-----------------AGTGCAGTAGGATACTGAAACTGACATTATTTG|TTAATGGCCAACCAAGA---------------------
                 SEQUENCER02:145:815YHABXX:5:2206:4424:117908
-------------------CTGAAACTGACATTATTTG|TTAATGGCCAGCCAAGACCCCTTGAATCAAG-------------------
                 SEQUENCER02:145:815YHABXX:5:1202:15250:141084
##################################################################
##########
145TTAGGC_5     +chr3:100438902_+chr3:100348442     TFG_GPR128    acceptor_template
****************************************************************
******
CATCATTTGGGACTGGGCATCTGGAGGATTGTGATCAGGATCCAAAGAG|GAAAATCTACTTCCTCATCAAGCACCCCTACAGAGTTC
TGCAGGAATGGT    junction_+chr3_100328815_+chr3_100348442_NM_032787
##################################################################
##########
145TTAGGC_5     +chr3:100438902_+chr3:100348442     TFG_GPR128    donor_genomic_template
****************************************************************
******
CCTTTCCTTTGCAATTCAGTGCAGTAGGATACTGAAACTGACATTATTTG|GTGAGTAGTAAACTTTCTAATGAATTTACTATTTTATT
CATTGTATTTTA    junction_+chr3_100438902_NM_006070
##################################################################
##########
145TTAGGC_5     +chr3:100438902_+chr3:100348442     TFG_GPR128
acceptor_genomic_template
```

FIGURE 3.100B

```
************************************************************************
*******
GAAATGAATCAGCCAGTTCATGACTATTCTGTTATTTATTGTTCTTTAGIGAAAATCTACTTCCTCATCAAGCACCCCTACAGAGTTC
TGCAGGAATGGT  junction_+chr3_100348442_NM_032787
###########################################################################
##########
```

FIGURE 3.100C

3.101 ESR1_AKAP12

```
145TTAGGC_6  +chr6:152201906_+chr6:151669846     ESR1_AKAP12   fusion_template
***************************************************************************
*******
CCAGGCCTGCCGGCTCCGTAAATGCTACGAAGTGGGAATGATGAAAGGTG|TTGGACAGAGAGACTCTGAAGATGTGAGCAAAAGAGAC
TCCGATAAAGAG   junction_+chr6_152201906_+chr6_151669846_NM_000125_NM_005100
---GCCGGCTCCGCAAATGCTACGAAGTGGGAATGATGAAAGGTG|TTGGACAG--------------------------------
       SEQUENCER02:145:815YHABXX:6:1205:7154:194061
----------------------------GGGAATGATGAAAGGTG|TTGGACAGAGAGACTCTGAAGATGTGAGCGAAA------
       SEQUENCER02:145:815YHABXX:6:1106:4772:192368
----------------------------GGGAATGATGAAAGGTG|TTGGACAGAGAGACTCTGAAGATGTGAGCGAAA------
       SEQUENCER02:145:815YHABXX:6:1106:9353:155437
----------------------------GGGAATGATGAAAGGTG|TTGGACAGAGAGACTCTGAAGATGTGAGCGAAA------
       SEQUENCER02:145:815YHABXX:6:1205:2590:158770
----------------------------GGGAATGATGAAAGGTG|TTGGACAGAGAGACTCTGAAGATGTGAGCGAAA------
       SEQUENCER02:145:815YHABXX:6:1207:20543:133606
----------------------------GGGAATGATGAAAGGTG|TTGGACAGAGAGACTCTGAAGATGTGAGCGAAA------
       SEQUENCER02:145:815YHABXX:6:2101:8038:74780
----------------------------GGGAATGATGAAAGGTG|TTGGACAGAGAGACTCTGAAGATGTGAGCGAAA------
       SEQUENCER02:145:815YHABXX:6:2202:3832:129382
----------------------------GGGAATGATGAAAGGTG|TTGGACAGAGAGACTCTGAAGATGTGAGCGAAA------
       SEQUENCER02:145:815YHABXX:6:2205:6677:137122
AAAGGTG|TTGGACAGAGAGACTCTGAAGATGTGAGCGAAAGAGACTCCGA-------
       SEQUENCER02:145:815YHABXX:6:1104:14776:152229
```

FIGURE 3.101A

```
AAAGGTG|TTGGACAGAGAGACTCTGAAGATGTGAGCGAAAGAGACTCCGA------------
        SEQUENCER02:145:815YHABXX:6:1105:10023:186349
-------------------------------------------------------------
AAAGGTG|TTGGACAGAGAGACTCTGAAGATGTGAGCGAAAGAGACTCCGA------------
        SEQUENCER02:145:815YHABXX:6:2101:17982:171668
-------------------------------------------------------------
AAAGGTG|TTGGACAGAGAGACTCTGAAGATGTGAGCGAAAGAGACTCCGA------------
        SEQUENCER02:145:815YHABXX:6:2102:14467:195340
-------------------------------------------------------------
AAAGGTG|TTGGACAGAGAGACTCTGAAGATGTGAGCGAAAGAGACTCCGA------------
        SEQUENCER02:145:815YHABXX:6:2104:7870:6755
-------------------------------------------------------------
AAAGGTG|TTGGACAGAGAGACTCTGAAGATGTGAGCGAAAGAGACTCCGA------------
        SEQUENCER02:145:815YHABXX:6:2204:21224:53471
-------------------------------------------------------------
AAAGGTG|TTGGACAGAGAGACTCTGAAGATGTGAGCGAAAGAGACTCCGA------------
        SEQUENCER02:145:815YHABXX:6:2207:10824:94403
-------------------------------------------------------------
AAAGGTG|TTGGACAGAGAGACTCTGAAGATGTGAGCGAAAGAGACTCCGA------------
        SEQUENCER02:145:815YHABXX:6:2207:19527:171758
-------------------------------------------------------------
AAAGGTG|TTGGACAGAGAGACTCTGAAGATGTGAGCGAAAGAGACTCCGA------------
        SEQUENCER02:145:815YHABXX:6:2208:7156:182445
###############################################################
############
145TTAGGC_6    +chr6:152201906 +chr6:151669846   ESR1_AKAP12    donor_template
***************************************************************
***********
CCAGGCCTGCCGGCTCCGTAAATGCTACGAAGTGGGAATGATGAAAGGTG|GGATACGAAAAGACCGAAGAGAGGAGAATGTTGAAA
CACAAGCGCCAG  junction_+chr6_152201906_+chr6_152265308_NM_000125
---------------GTGGGAATGATGAAAGGTG|GGATACGAAAAGACCGAAGAGAGGAGAAT------
        SEQUENCER02:145:815YHABXX:6:1101:14002:38107
```

FIGURE 3.101B

```
--------------------------------------------GTGGGAATGATGAAAGGTG|GGATACGAAAAGACCGAAGAGGAGGGAGAAT-------
---------SEQUENCER02:145:815YHABXX:6:2207:11432:52238
------------------------------------------TGGGAATGATGAAAGGTG|GGATATGAAAAGACCGAAGAGGAGGGAGAATG-------
---------SEQUENCER02:145:815YHABXX:6:1102:7288:179443
------------------------------------------TGGGAATGATGAAAGGTG|GGATATGAAAAGACCGAAGAGGAGGGAGAATG-------
---------SEQUENCER02:145:815YHABXX:6:2103:11962:15936
-----------------------------------------GGGAATGATGAAAGGTG|GGATACGAAAAGACCGAAGAGGAGGGAGAATGT-------
---------SEQUENCER02:145:815YHABXX:6:1101:11471:200157
-----------------------------------------GGGAATGATGAAAGGTG|GGATACGAAAAGACCGAAGAGGAGGGAGAATGT-------
---------SEQUENCER02:145:815YHABXX:6:1102:11370:179239
-----------------------------------------GGGAATGATGAAAGGTG|GGATACGAAAAGACCGAAGAGGAGGGAGAATGT-------
---------SEQUENCER02:145:815YHABXX:6:1103:19295:37137
-----------------------------------------GGGAATGATGAAAGGTG|GGATACGAAAAGACCGAAGAGGAGGGAGAATGT-------
---------SEQUENCER02:145:815YHABXX:6:1107:8388:47178
-----------------------------------------GGGAATGATGAAAGGTG|GGATACGAAAAGACCGAAGAGGAGGGAGAATGT-------
---------SEQUENCER02:145:815YHABXX:6:1208:20367:40269
-----------------------------------------GGGAATGATGAAAGGTG|GGATACGAAAAGACCGAAGAGGAGGGAGAATG-------
---------SEQUENCER02:145:815YHABXX:6:1208:7806:106706
-----------------------------------------GGGAATGATGAAAGGTG|GGATACGAAAAGACCGAAGAGGAGGGAGAATGT-------
---------SEQUENCER02:145:815YHABXX:6:2103:8911:45374
-----------------------------------------GGGAATGATGAAAGGTG|GGATACGAAAAGACCGAAGAGGAGGGAGAATGT-------
---------SEQUENCER02:145:815YHABXX:6:2105:17213:139304
-----------------------------------------GGGAATGATGAAAGGTG|GGATACGAAAAGACCGAAGAGGAGGGAGAATGT-------
---------SEQUENCER02:145:815YHABXX:6:2105:20166:74523
-----------------------------------------GGGAATGATGAAAGGTG|GGATACGAAAAGACCGAAGAGGAGGGAGAATGT-------
---------SEQUENCER02:145:815YHABXX:6:2106:15725:176752
-----------------------------------------GGGAATGATGAAAGGTG|GGATACGAAAAGACCGAAGAGGAGGGAGAATGT-------
---------SEQUENCER02:145:815YHABXX:6:2203:16827:148609
-----------------------------------------GGGAATGATGAAAGGTG|GGATACGAAAAGACCGAAGAGGAGGGAGAATGT-------
---------SEQUENCER02:145:815YHABXX:6:2205:2877:35656
-----------------------------------------GGGAATGATGAAAGGTG|GGATACGAAAAGACCGAAGAGGAGGGAGAATGT-------
---------SEQUENCER02:145:815YHABXX:6:2207:15067:193171
```

FIGURE 3.101C

```
                                    -------GGGAATGATGAAAGGTG|GGATACGAAAAGACCGAAGAGGAGGAGAATGT-----
          SEQUENCER02:145:815YHABXX:6:2208:11878:90188
##############################################################################
###########
145TTAGGC_6    +chr6:152201906_+chr6:151669846    ESR1_AKAP12    acceptor_template
***************************************************************************************
***********
TCAAGGAGCCCTAAACAGCCAGGAGGAAGAAGTCATTGTCACAGAGG|TTGGACAGAGAGACTCTGAAGATGTGAGCAAAAGAGAC
TCCGATAAAGAG    junction_+chr6:151627038_+chr6:151669846_NM_005100
##############################################################################
###########
145TTAGGC_6    +chr6:152201906_+chr6:151669846    ESR1_AKAP12    donor_genomic_template
***************************************************************************************
***********
CCAGGCCTGCCGGCTCCGTAAATGCTACGAAGTGGGAATGATGAAAGGTG|GTAGGTACATCTCTCCCAGGGCCCTTGGGGATGCCC
TGGCCCACCGCCC    junction_+chr6:152201906_NM_000125
##############################################################################
###########
145TTAGGC_6    +chr6:152201906_+chr6:151669846    ESR1_AKAP12    fusion_template
***************************************************************************************
***********
GTAATCACCTTTTCTCTTCTCCCCACCCCCCGCCCCTTTTTGTTAATAG|TTGGACAGAGAGACTCTGAAGATGTGAGCAAAAGAGAC
TCCGATAAAGAG    junction_+chr6:151669846_NM_005100
##############################################################################
###########
```

FIGURE 3.101D

```
3.102 FBXL20_NSF
146GCCAAT_1    -chr17:37453380_+chr17:44751780    FBXL20_NSF    fusion_template
***************************************************************************************
***********
```

FIGURE 3.102A

```
AGGAACATTGAAGTACTGAATCTAAATGGGTGTACAAAGACAACAGACGC|GTTGTAAACATGTTAAAGGCATCCTGTTATATGGACCC
CCAGGTTGTGGT    junction_-chr17_374533380_+chr17_44751780_NM_006178
-------------------AAATGGGTGTACAAAGACAACAGACGC|GTTGTAAACATGTTAAAGGCATC-------
              SEQUENCER02:146:8164NABXX:1:1101:8254:143669
-------------------AAATGGGTGTACAAAGACAACAGACGC|GTTGTAAACATGTTAAAGGCATC-------
              SEQUENCER02:146:8164NABXX:1:2108:10610:173716

CAGACGC|GTTGTAAACATGTTAAAGGCATCCTGTTATATGGACCCCCAGG-------
       SEQUENCER02:146:8164NABXX:1:1102:20724:15373
##################################################
146GCCAAT_1      -chr17:374533380_+chr17:44751780     FBXL20_NSF    donor_template
**************************************************

AGGAACATTGAAGTACTGAATCTAAATGGGTGTACAAAGACAACAGACGC|TACATGTACTAGCCTTAGCAAGTTCTGTTCCAAACTCA
GGCACCTTGACT    junction_-chr17_374533380_-chr17_374441826_NM_032875
-------------AAATGGGTGTACAAAGACAACAGACGC|TACATGTACTAGCCTTAGCAAGT--------
              SEQUENCER02:146:8164NABXX:1:2207:18152:139662
##################################################
146GCCAAT_1      -chr17:374533380_+chr17:44751780     FBXL20_NSF    acceptor_template
**************************************************

ACGAGCATTTGCTTCCCGAGTATTTCCTCCAGAGATTGTGGAGCAGATGG|GTTGTAAACATGTTAAAGGCATCCTGTTATATGGACCC
CCAGGTTGTGGT    junction_+chr17_44720625_+chr17_44751780_NM_006178
##################################################
146GCCAAT_1      -chr17:374533380_+chr17:44751780     FBXL20_NSF    donor_genomic_template
**************************************************

AGGAACATTGAAGTACTGAATCTAAATGGGTGTACAAAGACAACAGACGC|GTAAGTATTTTATGTTTTTGGAGGATAAGTCATAACCC
CTTATGTCTGGC    junction_-chr17_374533380_NM_032875
```

FIGURE 3.102B

```
------------------------------------------AAATGGGTGTACAAAGACAACAGACGC|GTAAGTATTTTATGTTTTGGAG-------
                    SEQUENCER02:146:8164NABXX:1:1102:2618:141203
----------------------------------------AAATGGGTGTACAAAGACAACAGACGC|GTAAGTATTTTATGTTTTGGAG---------
                    SEQUENCER02:146:8164NABXX:1:1105:4897:138899
----------------------------------------AAATGGGTGTACAAAGACAACAGACGC|GTAAGTATTTTATGTTTTGGAG---------
                    SEQUENCER02:146:8164NABXX:1:1106:15097:110023
----------------------------------------AAATGGGTGTACAAAGACAACAGACGC|GTAAGTATTTTATGTTTTGGAG---------
                    SEQUENCER02:146:8164NABXX:1:1205:5833:119192
----------------------------------------AAATGGGTGTACAAAGACAACAGACGC|GTAAGTATTTTATGTTTTGGAG---------
                    SEQUENCER02:146:8164NABXX:1:1206:13008:53683
----------------------------------------AAATGGGTGTACAAAGACGACAGACGC|GTAAGTATTTTATGTTTTGGAG---------
                    SEQUENCER02:146:8164NABXX:1:1206:19367:134428
----------------------------------------AAATGGGTGTACAAAGACAACAGACGC|GTAAGTATTTTATGTTTTGGAG---------
                    SEQUENCER02:146:8164NABXX:1:1206:4151:154573
----------------------------------------AAATGGGTGTACAAAGACAACAGACGC|GTAAGTATTTTATGTTTTGGAG---------
                    SEQUENCER02:146:8164NABXX:1:2202:16083:90257
----------------------------------------AAATGGGTGTACAAAGACAACAGACGC|GTAAGTATTTTATGTTTTGGAG---------
                    SEQUENCER02:146:8164NABXX:1:2208:6354:104854
------------------------------------TGGGTGTACAAAGACAACAGACGC|GTAAGTATTTTATGTTTTGGAGA---------------
                    SEQUENCER02:146:8164NABXX:1:2203:8439:21192
GACGC|GTAAGTATTTTATGTTTTGGAGGATAAGTCATAACCCCTTATG-------
                    SEQUENCER02:146:8164NABXX:1:1207:1342:121229
GACGC|GTAAGTATTTTATGTTTTGGAGGATAAGTCATAACCCCTTATG-------
                    SEQUENCER02:146:8164NABXX:1:2103:19053:13734
GACGC|GTAAGTATTTTATGTTTTGGAGGATAAGTCATAACCCCTTATG-------
                    SEQUENCER02:146:8164NABXX:1:2107:9876:96941
GACGC|GTAAGTATTTTATGTTTTGGAGGATAAGTCATAACCCCTTATG-------
                    SEQUENCER02:146:8164NABXX:1:2204:2398:57579
```

FIGURE 3.102C

```
################################################################################
################
146GCCAAT_1      -chr17:37453380_+chr17:44751780      FBXL20_NSF
*******************************************************************************
************    acceptor_genomic_template
TACTTAGATTCTAGTTAGCTGATATAAGACTGTTTTCTTTTCCTTTTCAG|GTTGTAAACATGTTAAAGGCATCCTGTTATATGGACCC
CCAGGTTGTGGT      junction_+chr17_44751780_NM_006178
################################################################################
###############
```

FIGURE 3.102D

3.103 ZBTB46_DNAJC5

```
146GCCAAT_1      -chr20:62421174_+chr20:62559688      ZBTB46_DNAJC5_fusion_template
*******************************************************************************
***********
GCCGTCCTTCCTGCCGACGTCGGGGTGGCCGTTCAGCAGCCGAGACTCAA|AATAGCCTAACATGGCAGACCAGCAGCGCTCACTG
TCTACCTCTGGG      junction_-chr20_62421174_+chr20_62559688_NM_025224_NM_025219
----------------GGTGGCCGTTCAGCAGCCGAGACTCAA|AATAGCCTAACATGGCAGACCAG------
                 SEQUENCER02:146:8164NABXX:1:1206:5697:174012
################################################################################
########

146GCCAAT_1      -chr20:62421174_+chr20:62559688      ZBTB46_DNAJC5_donor_template
*******************************************************************************
***********
GCCGTCCTTCCTGCCGACGTCGGGGTGGCCGTTCAGCAGCCGAGACTCAA|ATGCGGACCTGTCCGTCACCGAAGCCAGCAGCCGAC
AGCCGAGGAGAG      junction_-chr20_62421174_-chr20_62407315_NM_025224
-------------CGGGGTGGCCGTTCAGCAGCCGAGACTCAA|ATGCGGACCTGTCCGTCA-----------
                 SEQUENCER02:146:8164NABXX:1:1104:14900:36006
----------------CGGGGTGGCCGTTCAGCAGCCGAGACTCAA|ATGCGGACCTGTCCGTCAC--------
                 SEQUENCER02:146:8164NABXX:1:1208:4406:81887
-----------------------GCAGCCGAGACTCAA|ATGCGGACCTGTCCGTCACCGAAGCCAGCAGCTCC--
                 SEQUENCER02:146:8164NABXX:1:1101:20327:79745
```

```
TGTTATAAAACCTGAAAATTCTCTTGTGCTTTCTCTTCTTTGCTTCTAG|TTACCATCCTCAAAGGATTGGCTAAAAGCAAGCAACTG
GATTGAACACACCC   junction_+chr4_71337932_NM_001145006
################################################################################

```

3.105 AP2B1_FLJ42280

```
146TTAGGC_5     +chr17:33968994   -chr7:96115729     AP2B1_FLJ42280 fusion_template
****************************************************************************************
******
CATCAGAGAAACACAGGAGCTAGTCCAGCAGGTCTTGAGTTTGGCAACACAG|GACTCCAACATTTGTCTGTTTGCTGTGTACAAGGAGG
AAAAGTGGGAAG    junction_+chr17_33968994_-chr7_96115729_NM_001282_NM_001201450
----------GCAGGTCTTGAGTTTGGCAACACAG|GACTCCAACATTTGTCTGTGTTTG----------------
          SEQUENCER02:146:8164NABXX:5:1101:17369:149263
----------GCAGGTCTTGAGTTTGGCAACACAG|GACTCCAACATTTGTCTGTGTTTG----------------
          SEQUENCER02:146:8164NABXX:5:1103:7300:121445
----------GCAGGTCTTGAGTTTGGCAACACAG|GACTCCAACATTTGTCTGTGTTTG----------------
          SEQUENCER02:146:8164NABXX:5:1104:17324:22873
----------GCAGGTCTTGAGTTTGGCAACACAG|GACTCCAACATTTGTCTGTGTTTG----------------
          SEQUENCER02:146:8164NABXX:5:1108:11074:127403
----------GCAGGTCTTGAGTTTGGCAACACAG|GACTCCAACATTTGTCTGTGTTTG----------------
          SEQUENCER02:146:8164NABXX:5:1108:6039:60003
----------GCAGGTCTTGAGTTTGGCAACACAG|GACTCCAACATTTGTCTGTGTTTG----------------
          SEQUENCER02:146:8164NABXX:5:1201:8262:52463
----------GCAGGTCTTGAGTTTGGCAACACAG|GACTCCAACATTTGTCTGTGTTTG----------------
          SEQUENCER02:146:8164NABXX:5:2208:14548:46864
################################################################################

146TTAGGC_5     +chr17:33968994   -chr7:96115729     AP2B1_FLJ42280 donor_template
****************************************************************************************
******
CATCAGAGAAACACAGGAGCTAGTCCAGCAGGTCTTGAGTTTGGCAACACAG|GATTCTGATAATCCTGACCTTCGAGACCGGGCTATAT
TTATTGGCGCCT    junction_+chr17_33977549_NM_001282
```

```
************************************************************
*************
CTCCTGCCAGCCTGAAAGGTCTAGGATAATACCTTCAACTTCCCTTATAG|GACTCCAACATTTGTGCTGTGTTTGCTGTGTACAAGGAGG
AAAAGTGGGAAG   junction_-chr7_96115729_NM_001201450
##############################################################
#############
```

FIGURE 3.105C

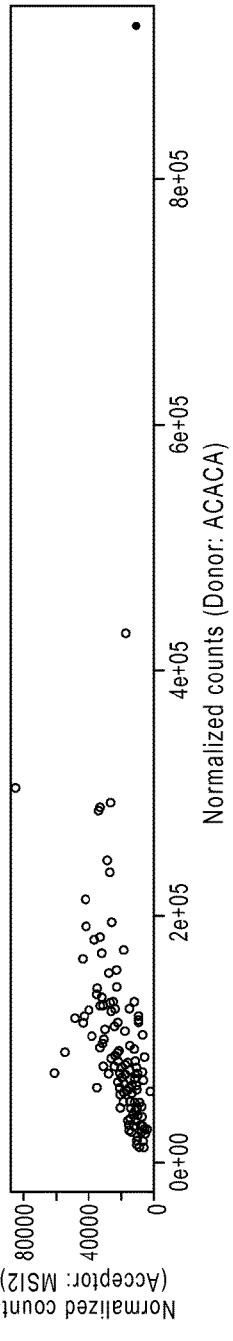
FIGURE 4.1A
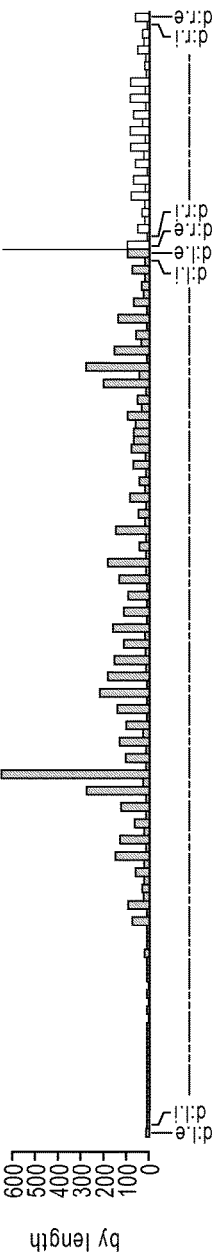
FIGURE 4.1B
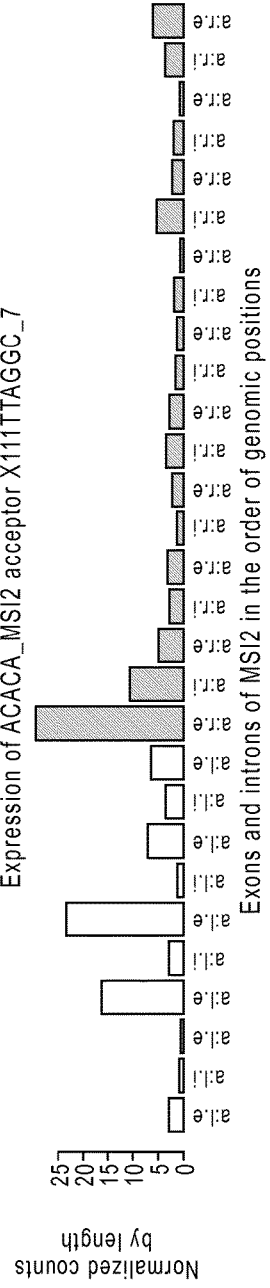
FIGURE 4.1C

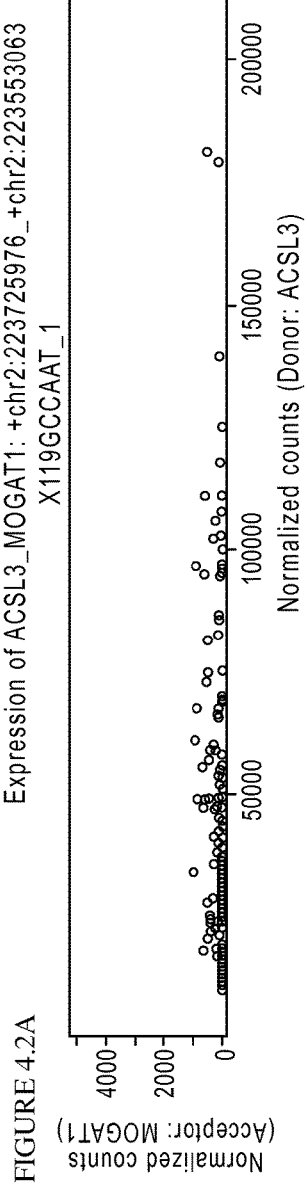
FIGURE 4.2A
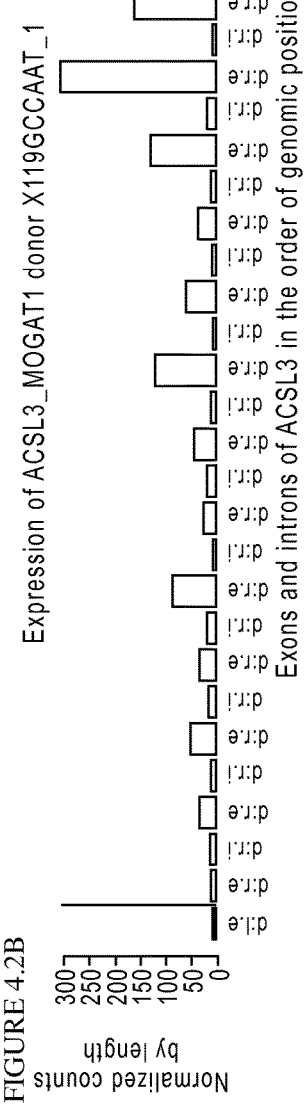
FIGURE 4.2B
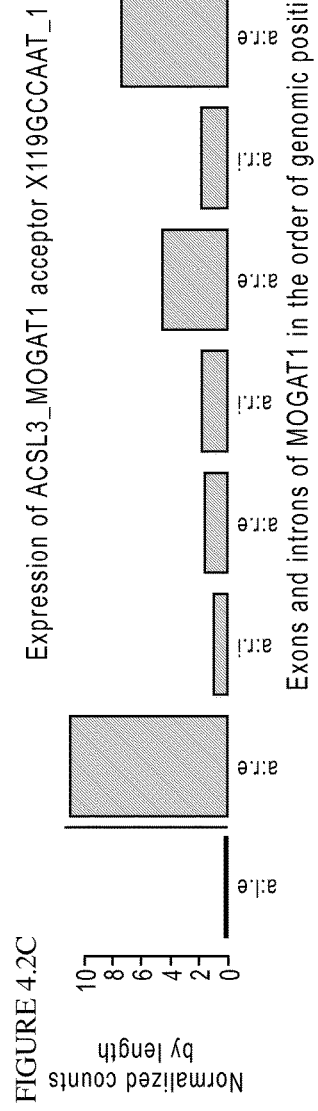
FIGURE 4.2C

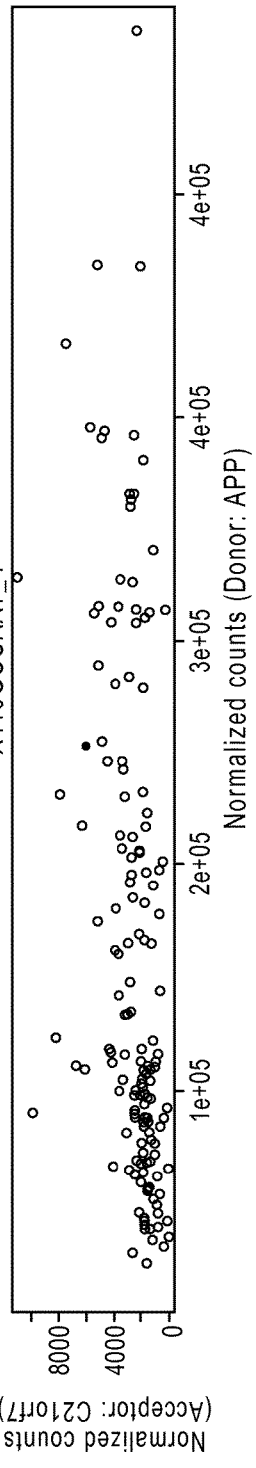
FIGURE 4.4A
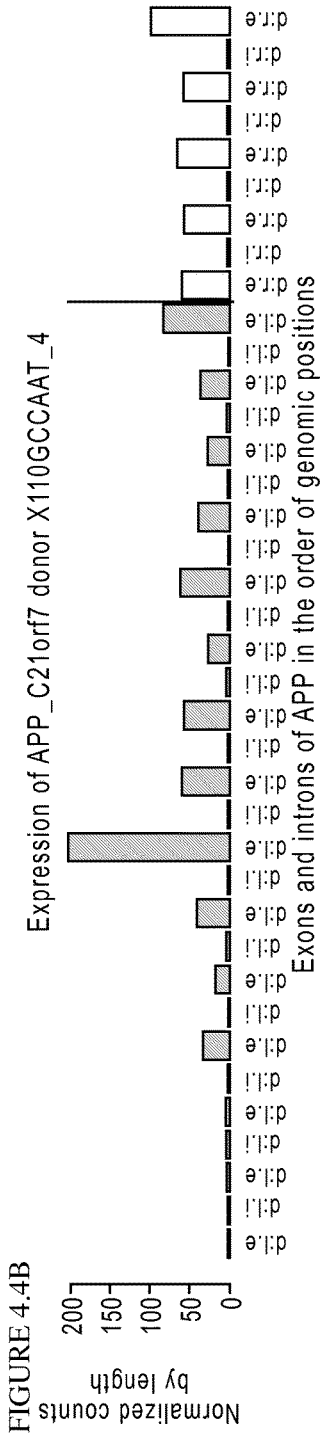
FIGURE 4.4B
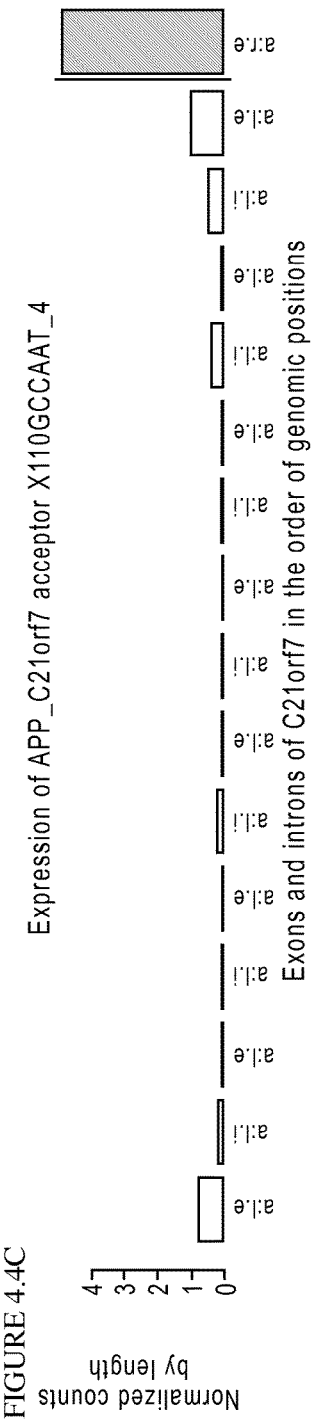
FIGURE 4.4C

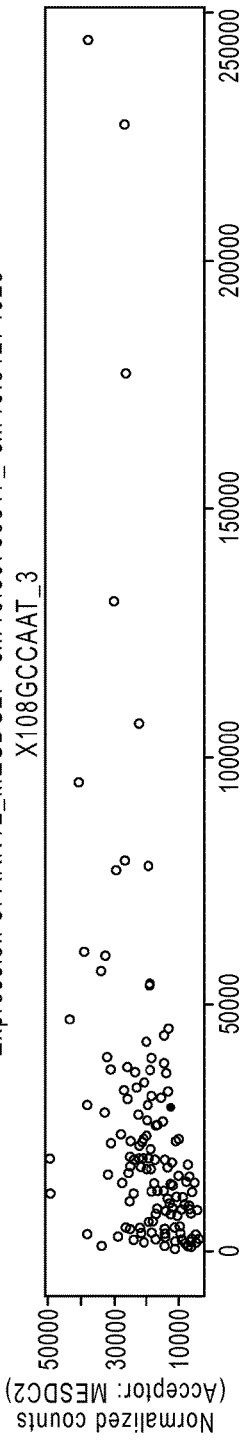
FIGURE 4.5A
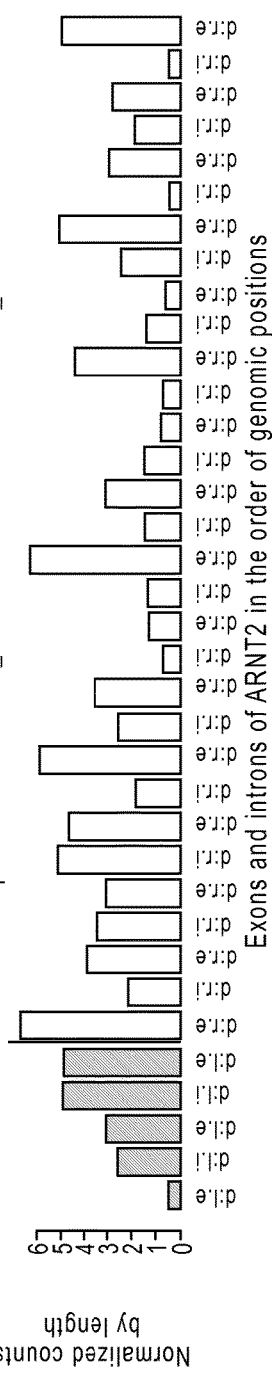
FIGURE 4.5B
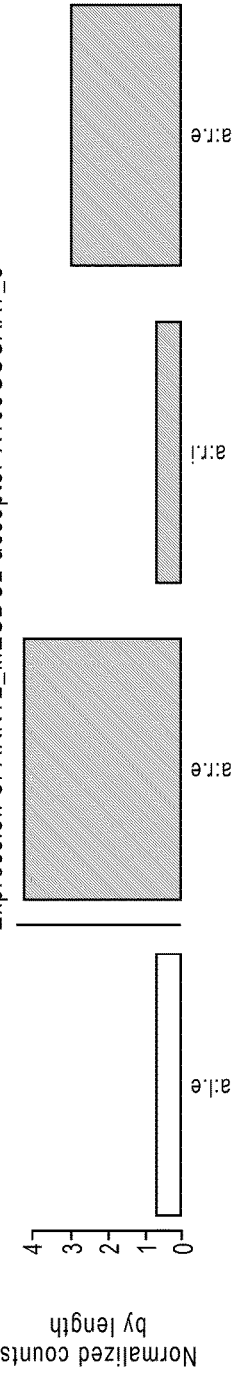
FIGURE 4.5C

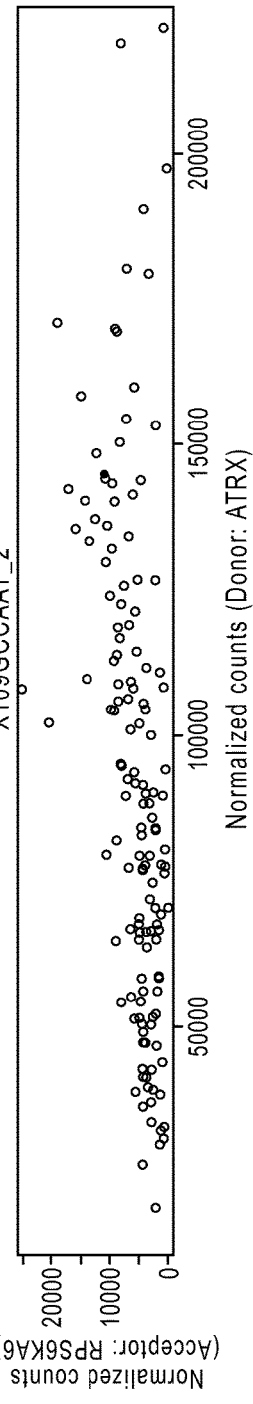
FIGURE 4.6A
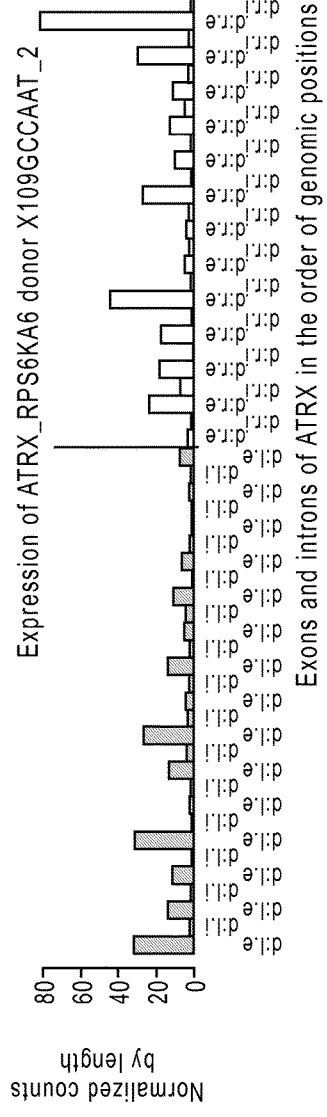
FIGURE 4.6B
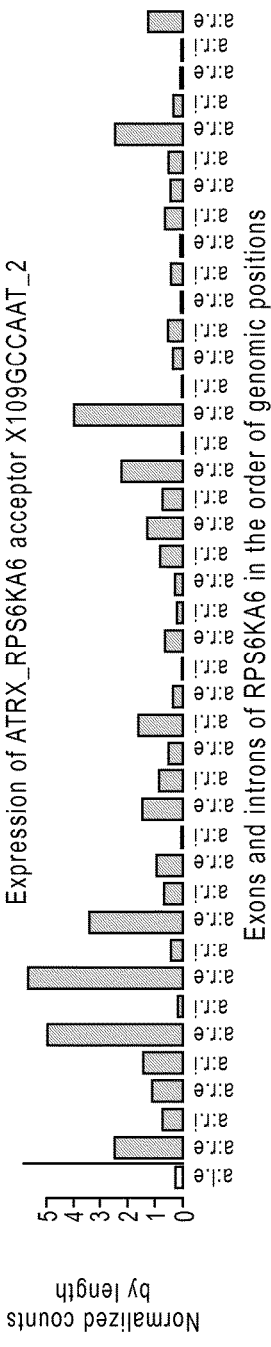
FIGURE 4.6C

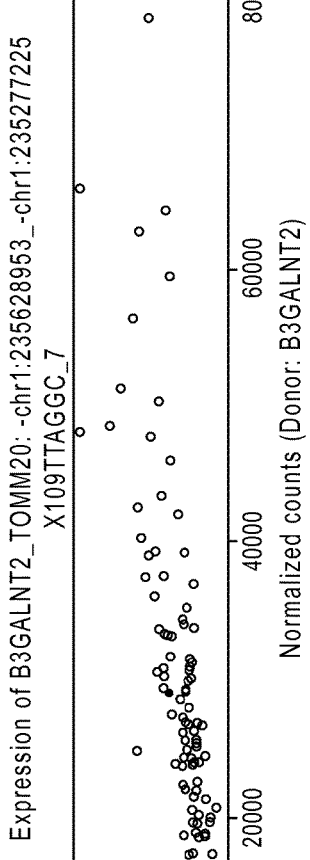
FIGURE 4.7A
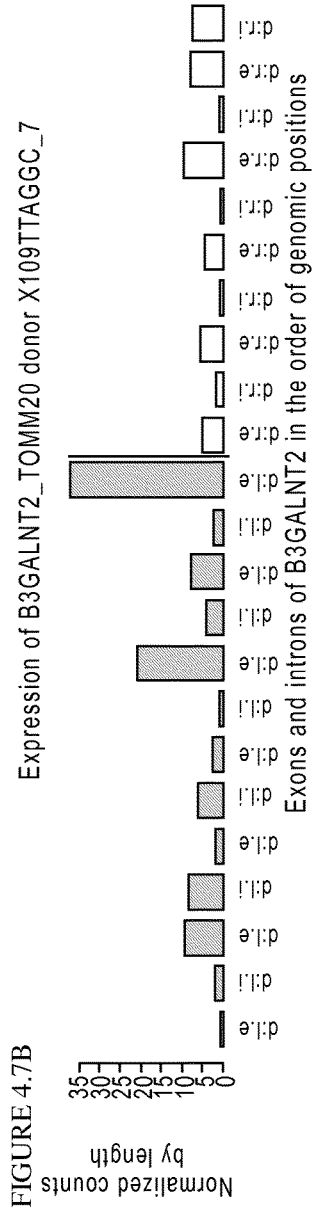
FIGURE 4.7B
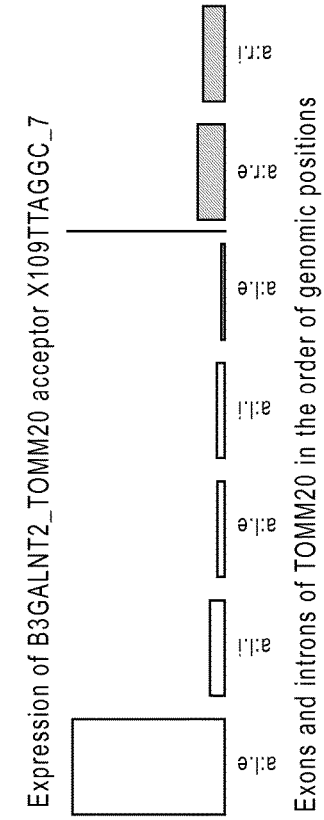
FIGURE 4.7C

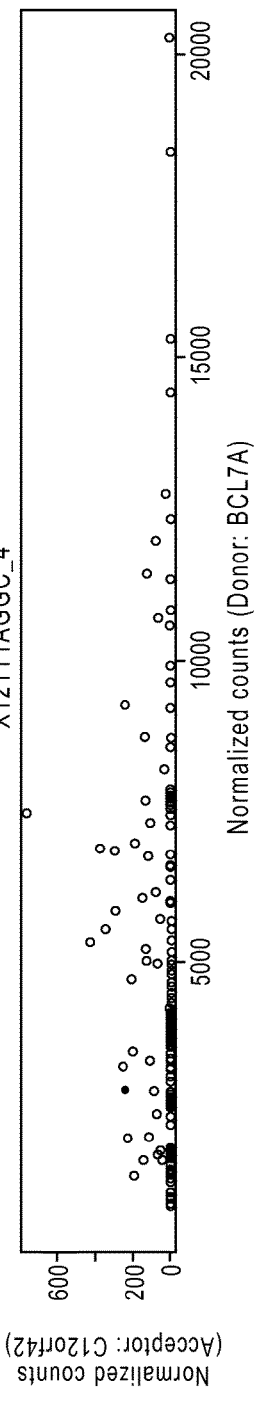
FIGURE 4.8A
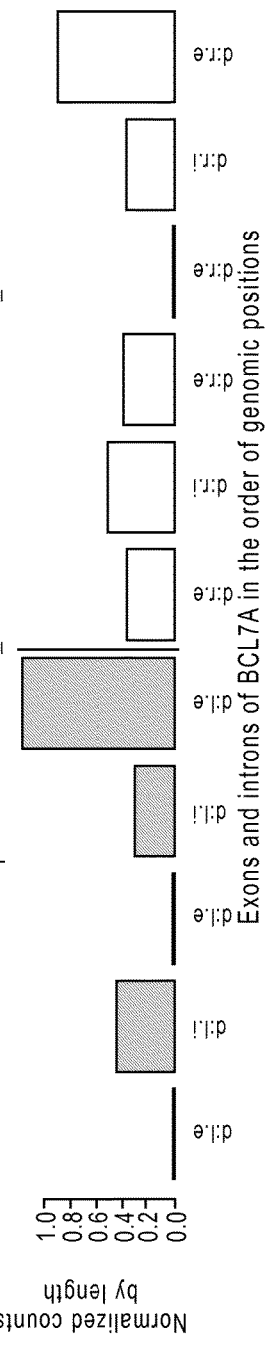
FIGURE 4.8B
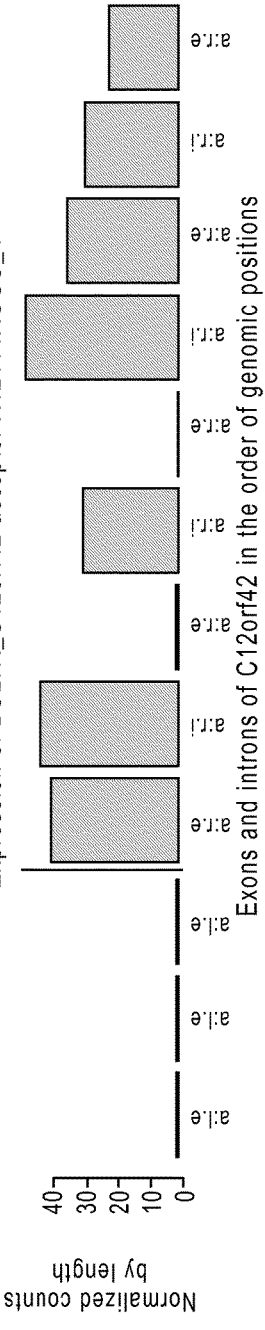
FIGURE 4.8C

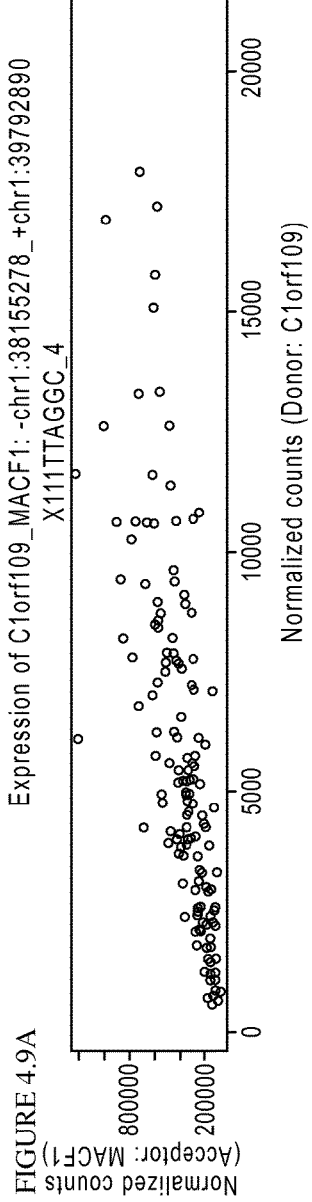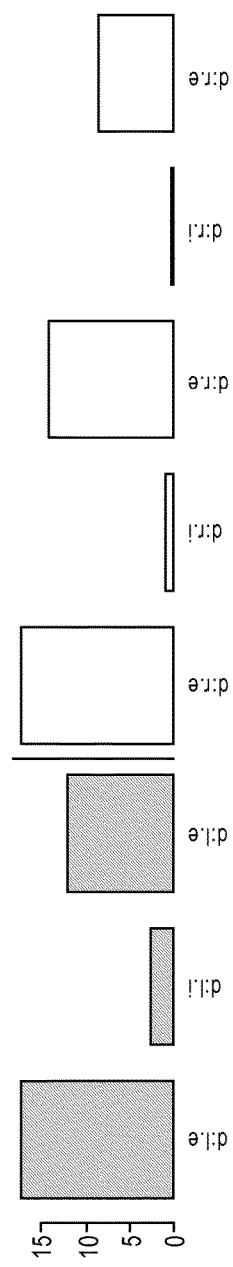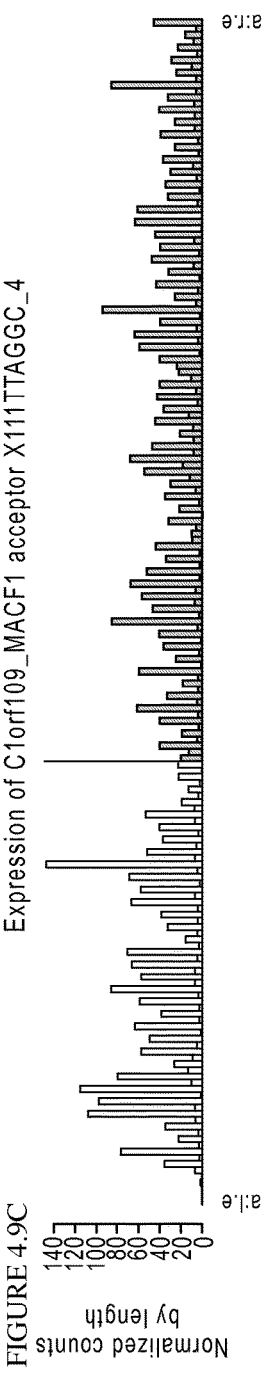

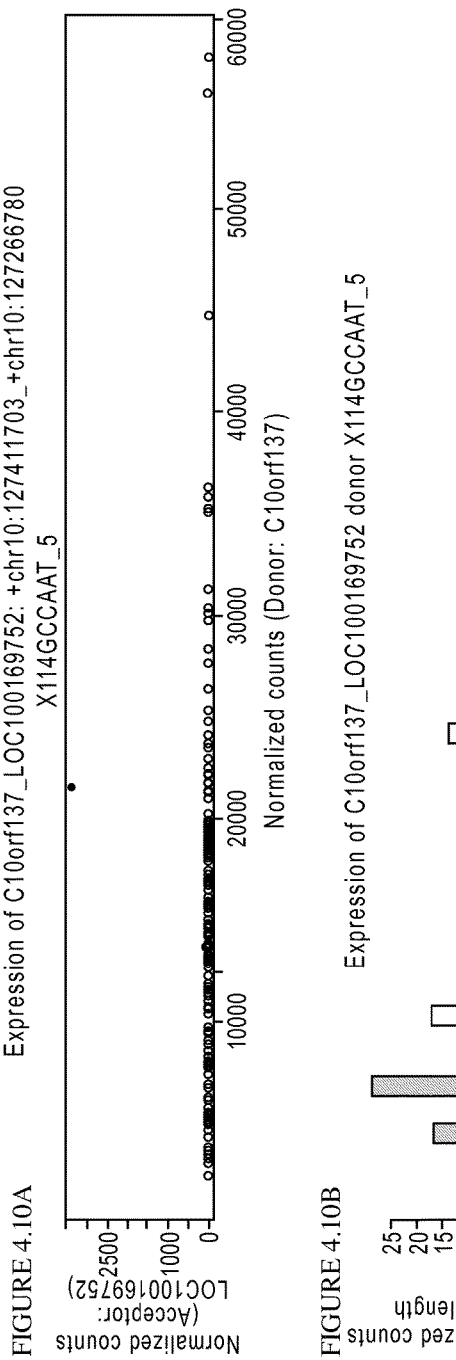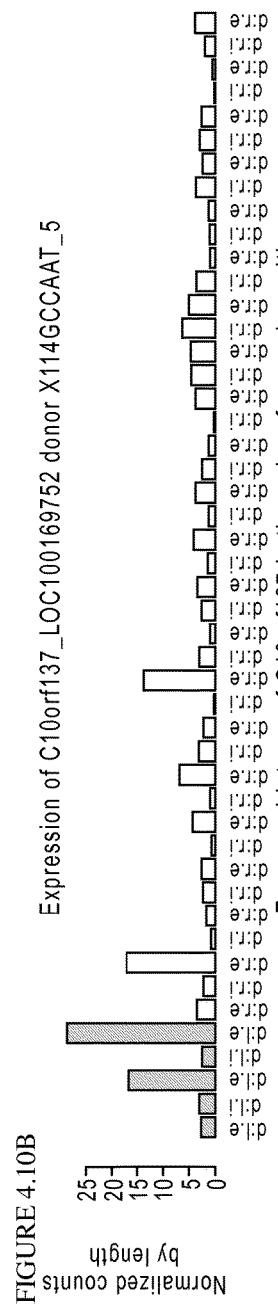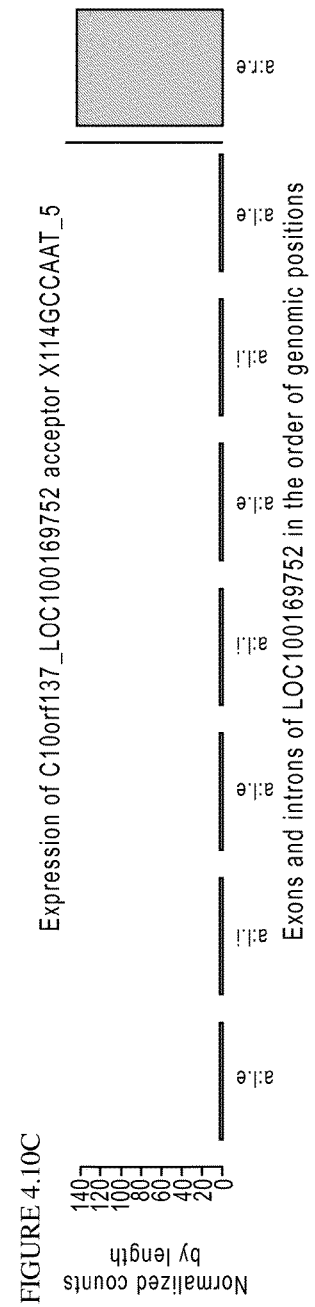
FIGURE 4.10A  FIGURE 4.10B  FIGURE 4.10C

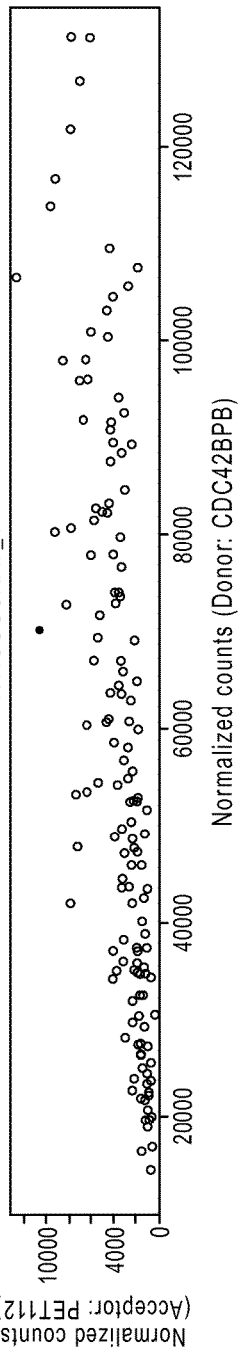
FIGURE 4.11A
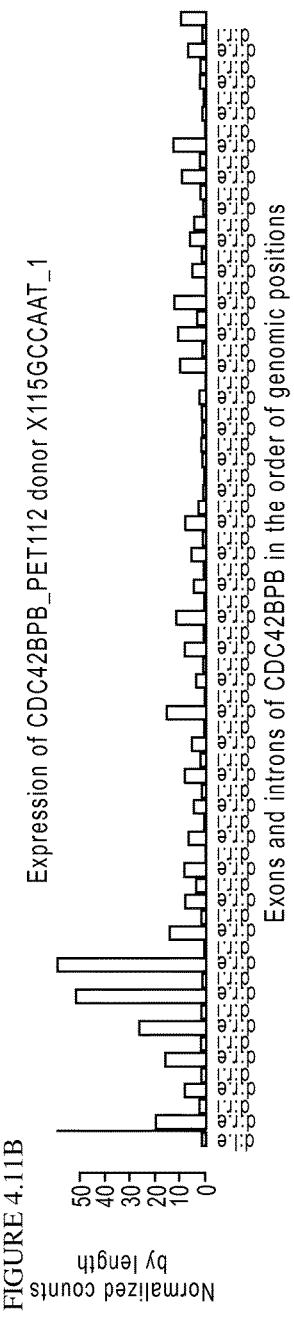
FIGURE 4.11B
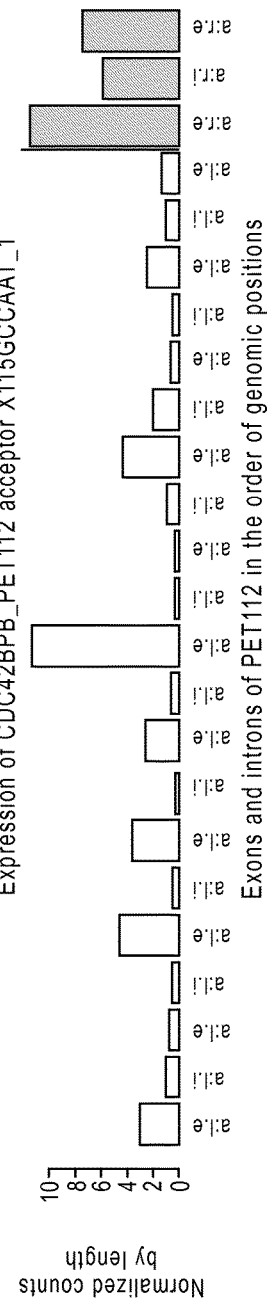
FIGURE 4.11C

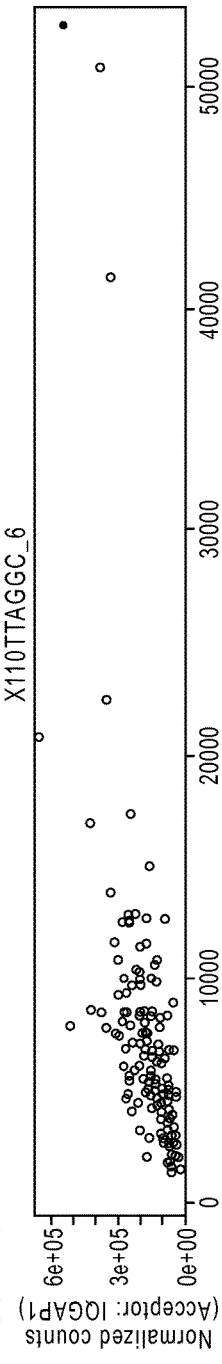
FIGURE 4.12A
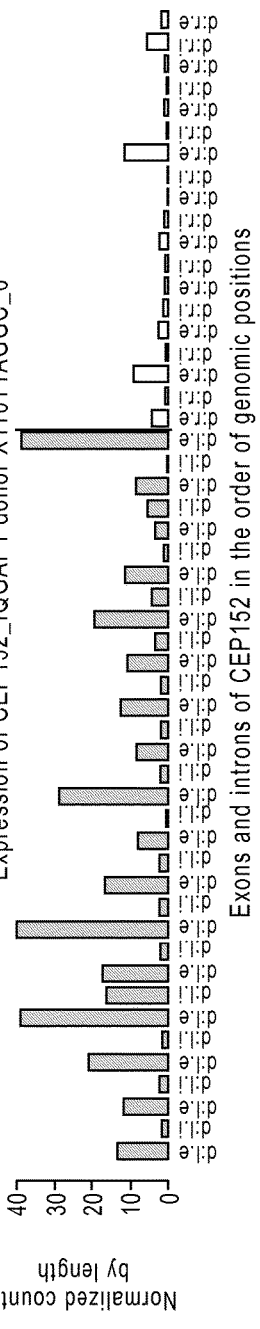
FIGURE 4.12B
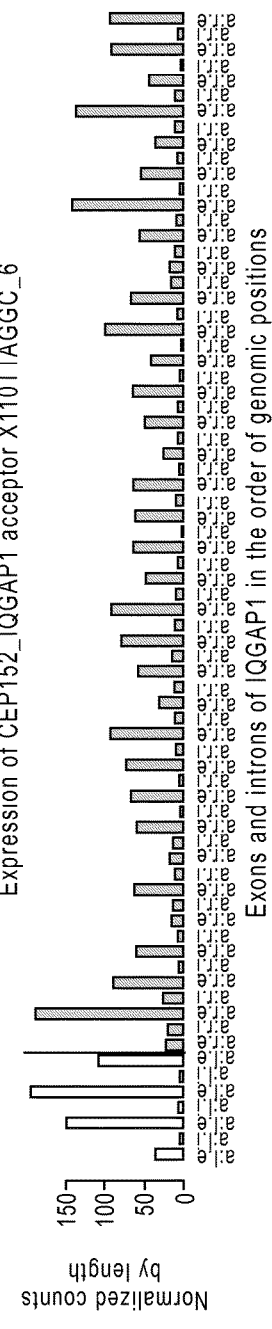
FIGURE 4.12C

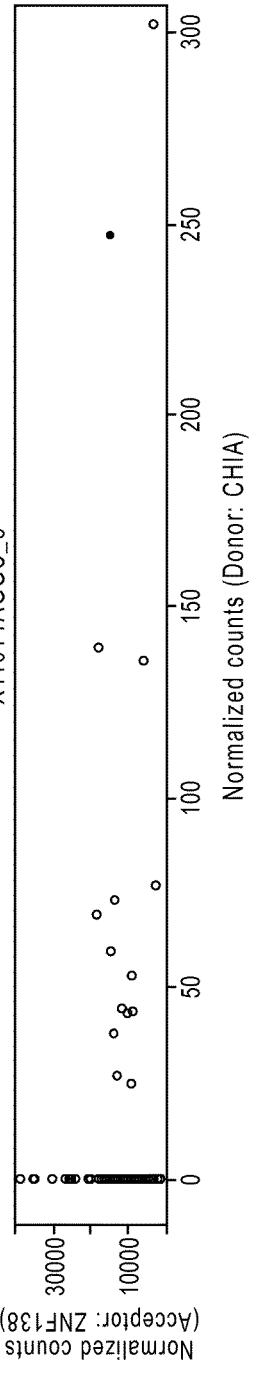
FIGURE 4.13A
FIGURE 4.13B
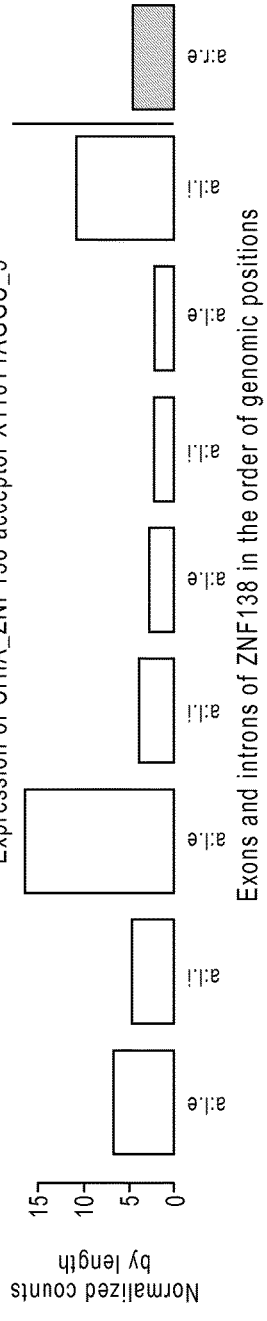
FIGURE 4.13C

FIGURE 4.14A
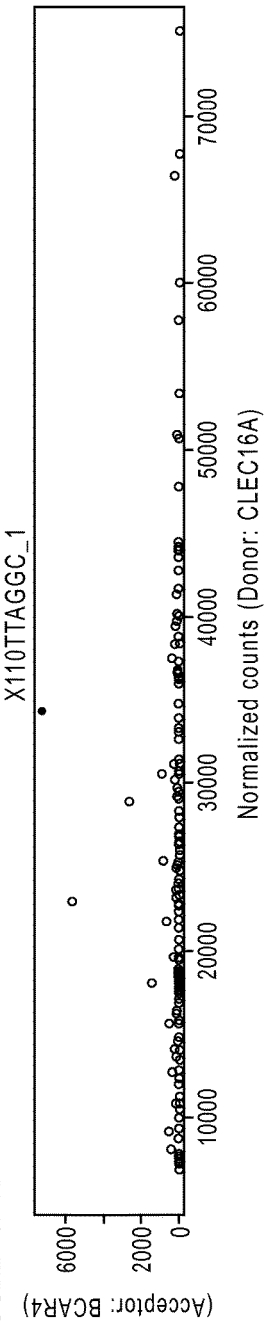
FIGURE 4.14B
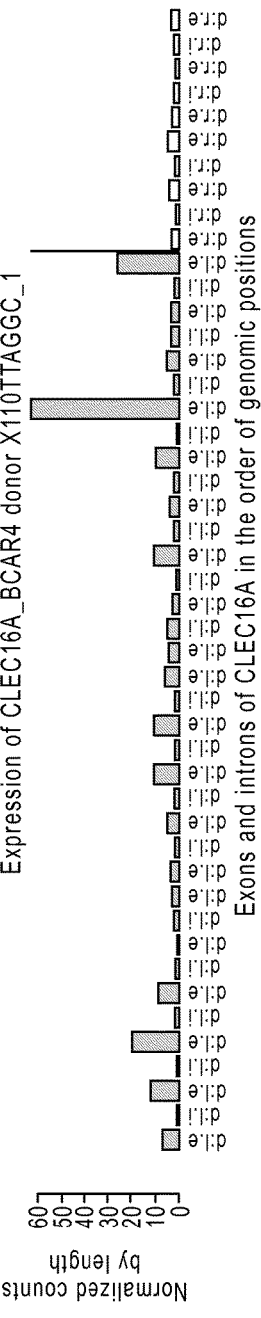
FIGURE 4.14C

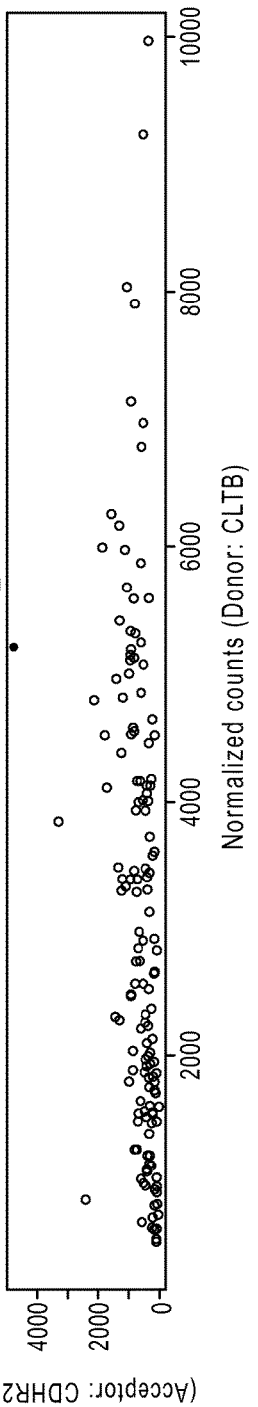
FIGURE 4.15A
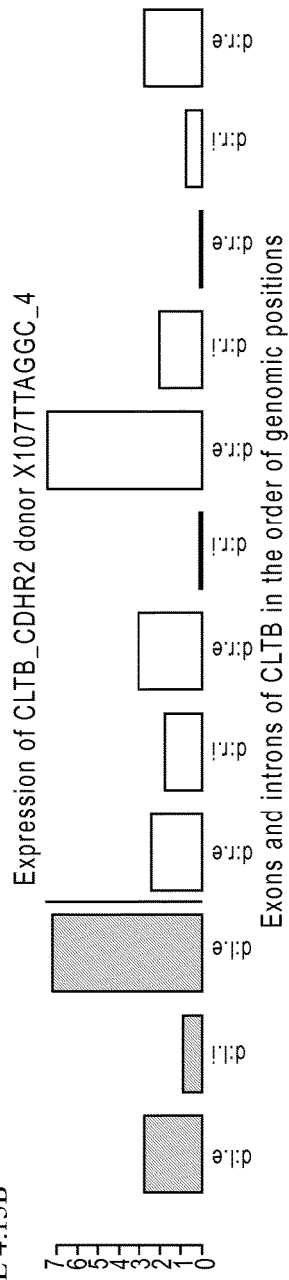
FIGURE 4.15B
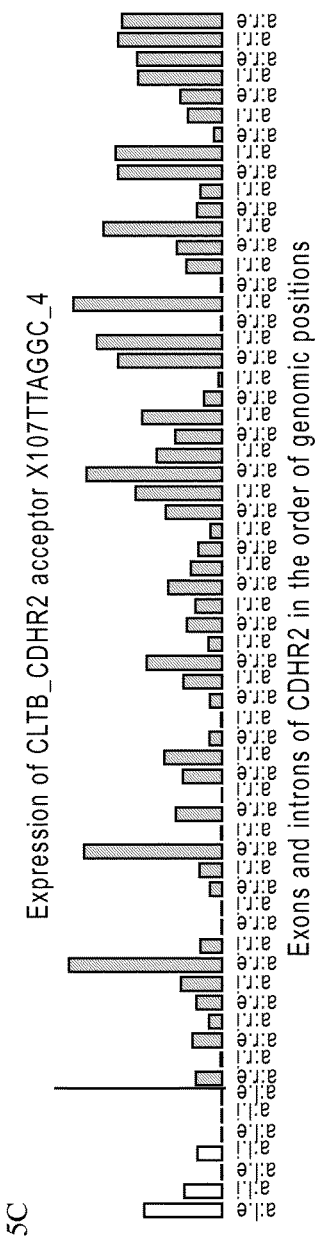
FIGURE 4.15C

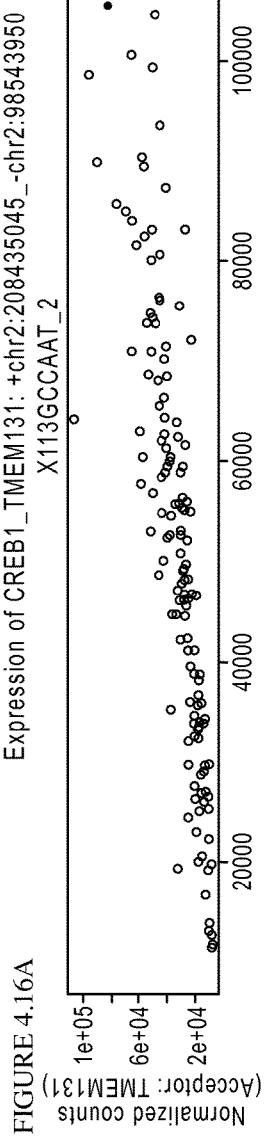
FIGURE 4.16A
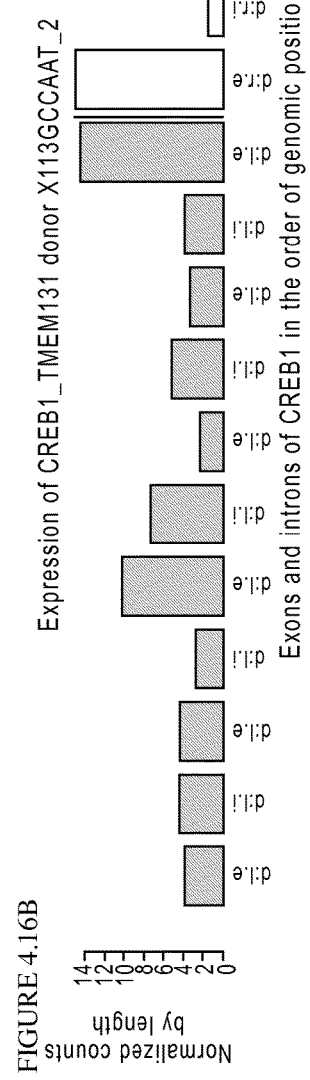
FIGURE 4.16B
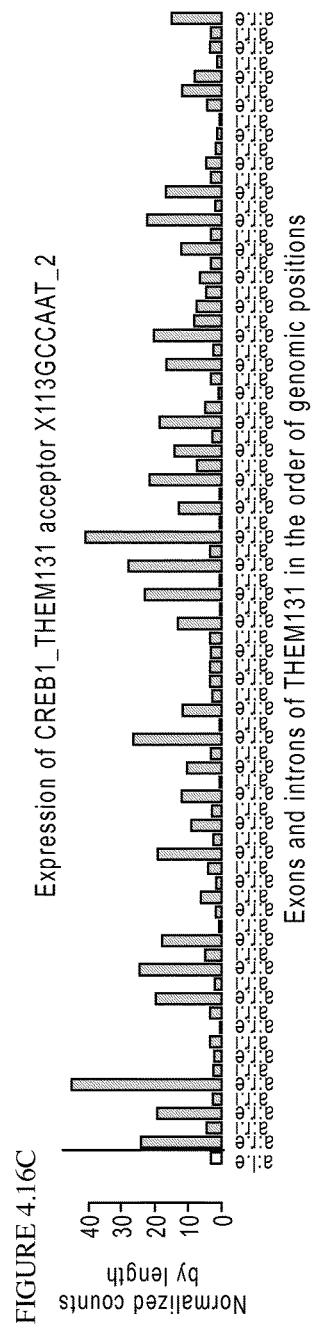
FIGURE 4.16C

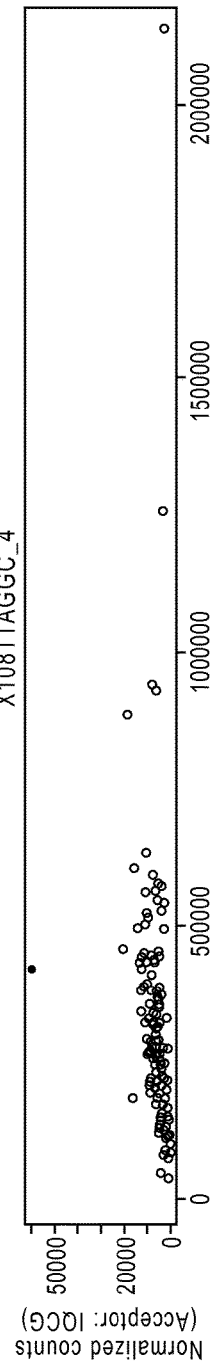
FIGURE 4.17A
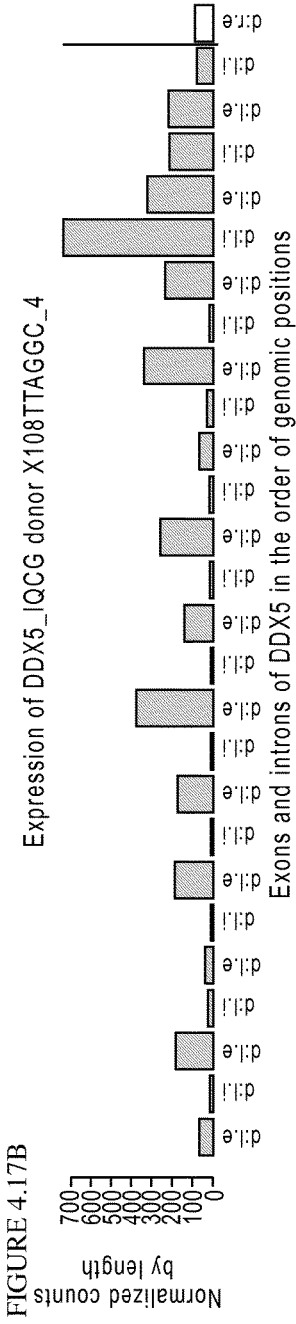
FIGURE 4.17B
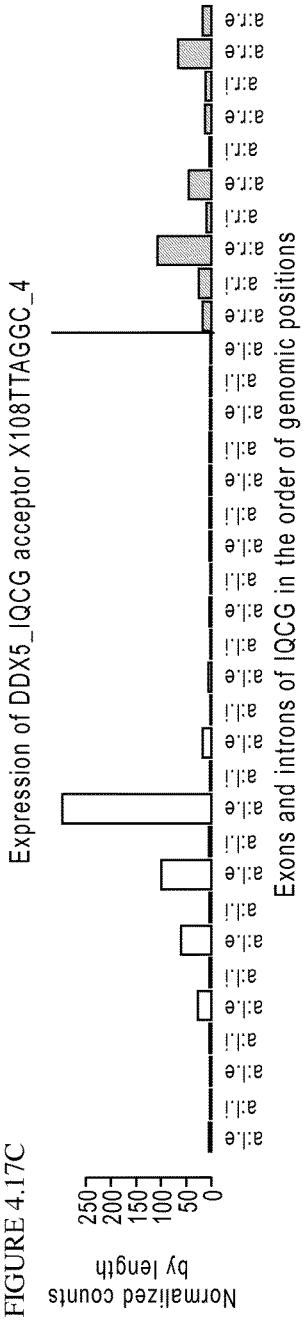
FIGURE 4.17C

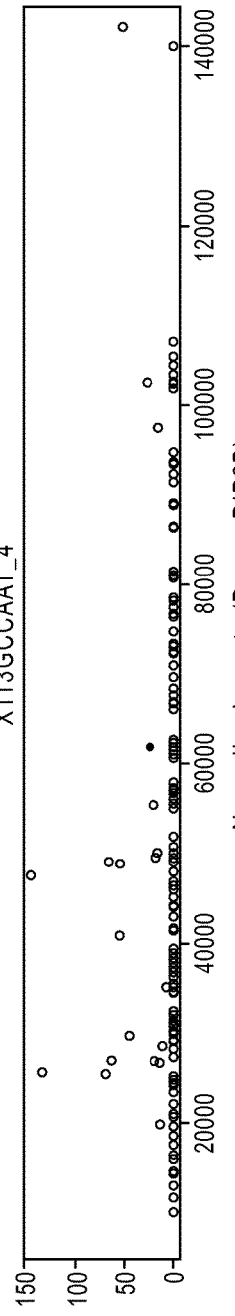
FIGURE 4.18A
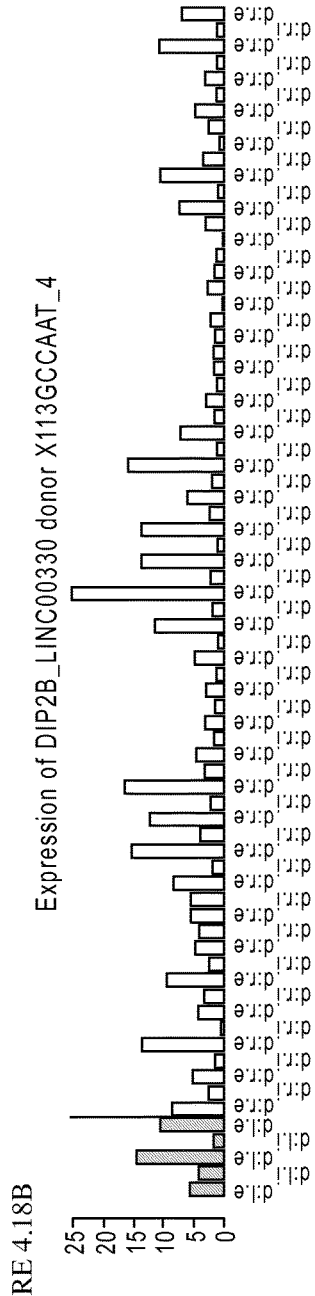
FIGURE 4.18B
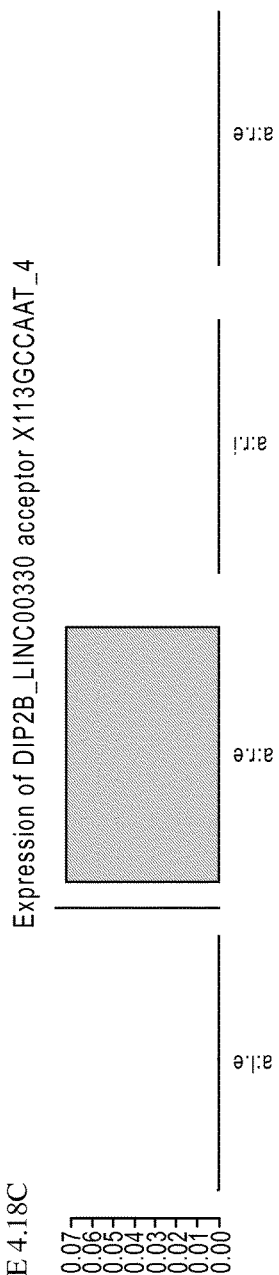
FIGURE 4.18C

FIGURE 4.19A
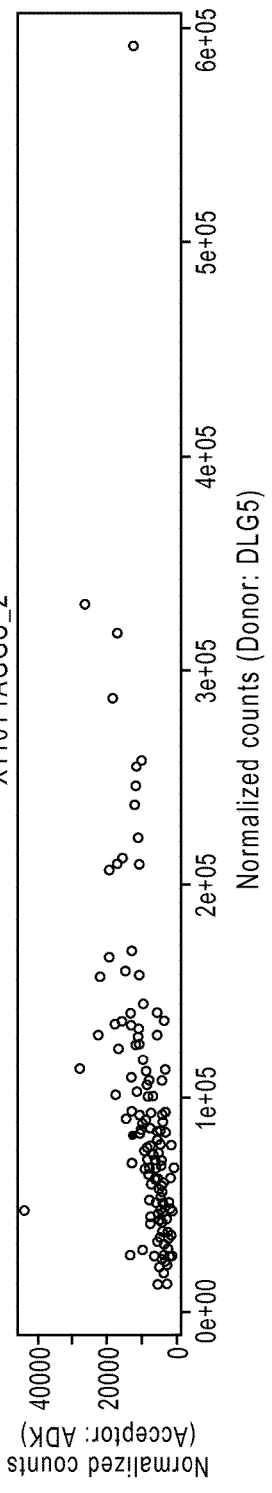
FIGURE 4.19B
FIGURE 4.19C
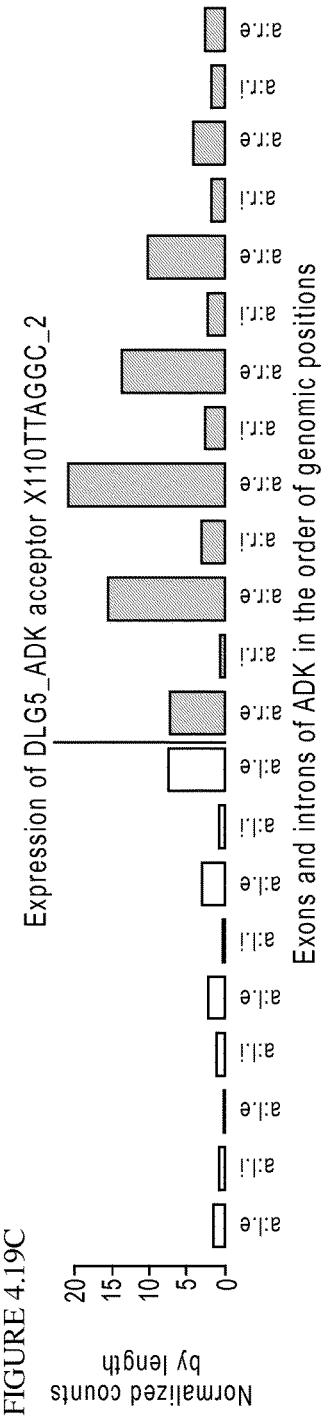

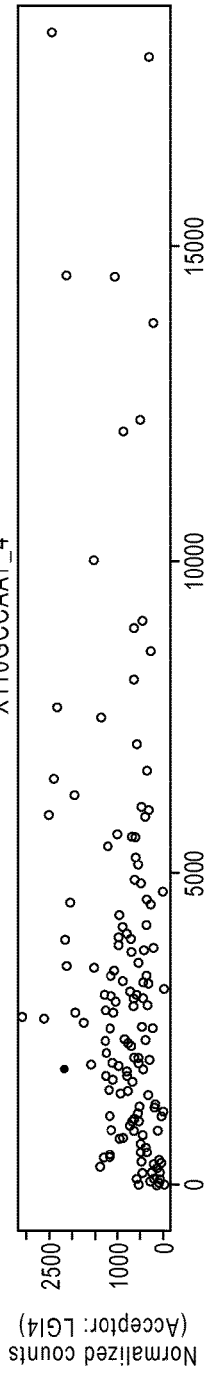
FIGURE 4.20A
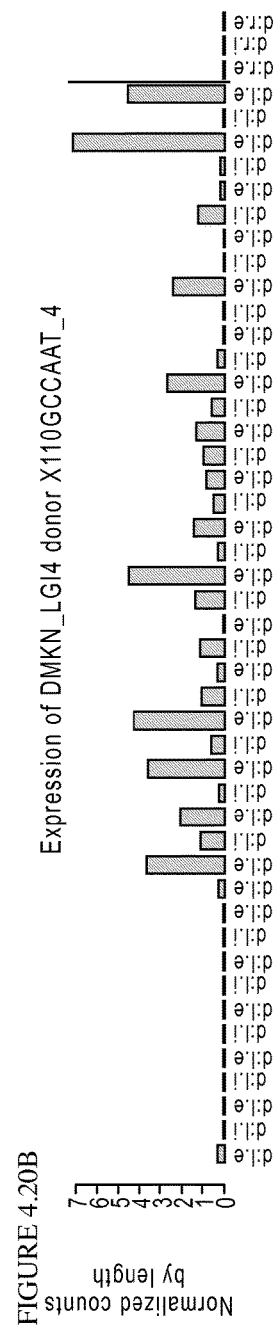
FIGURE 4.20B
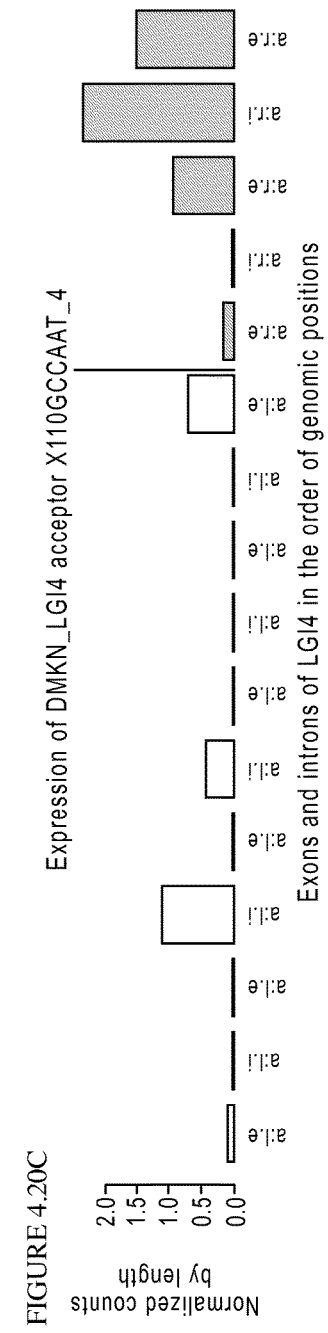
FIGURE 4.20C

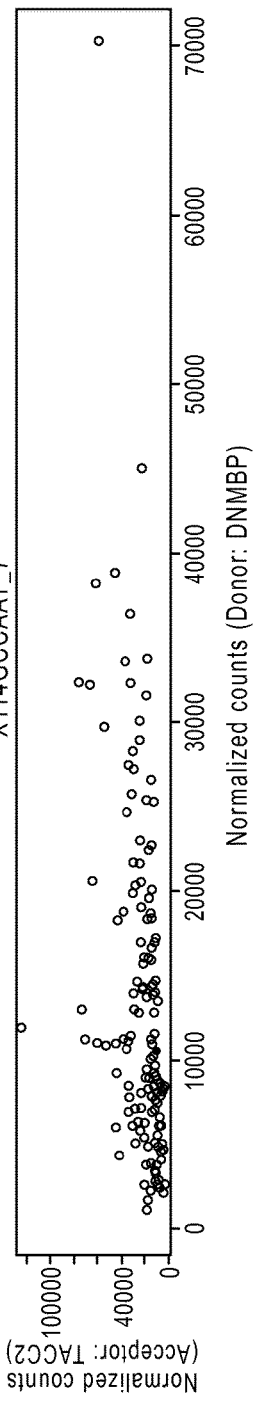
FIGURE 4.21A
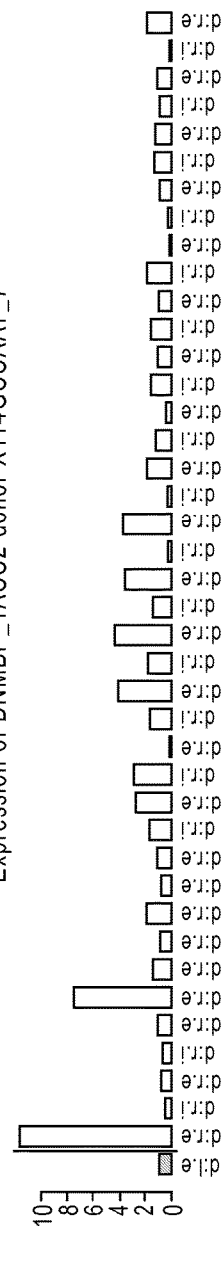
FIGURE 4.21B
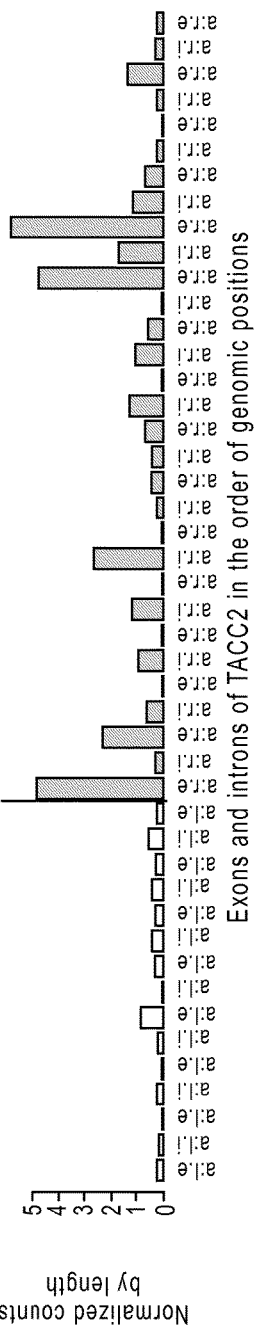
FIGURE 4.21C

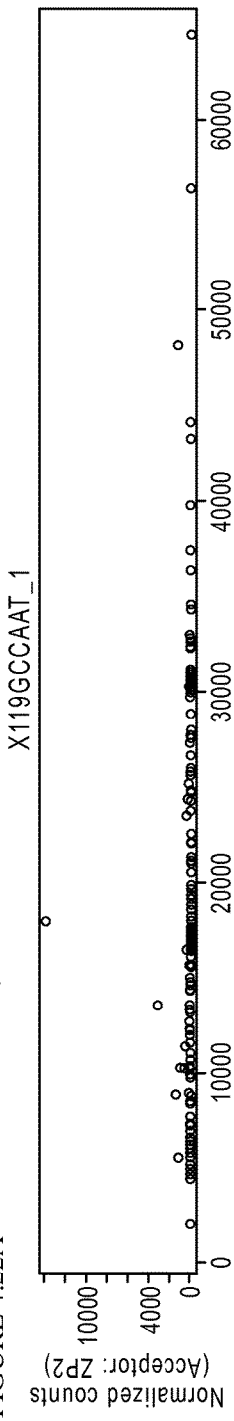
FIGURE 4.22A
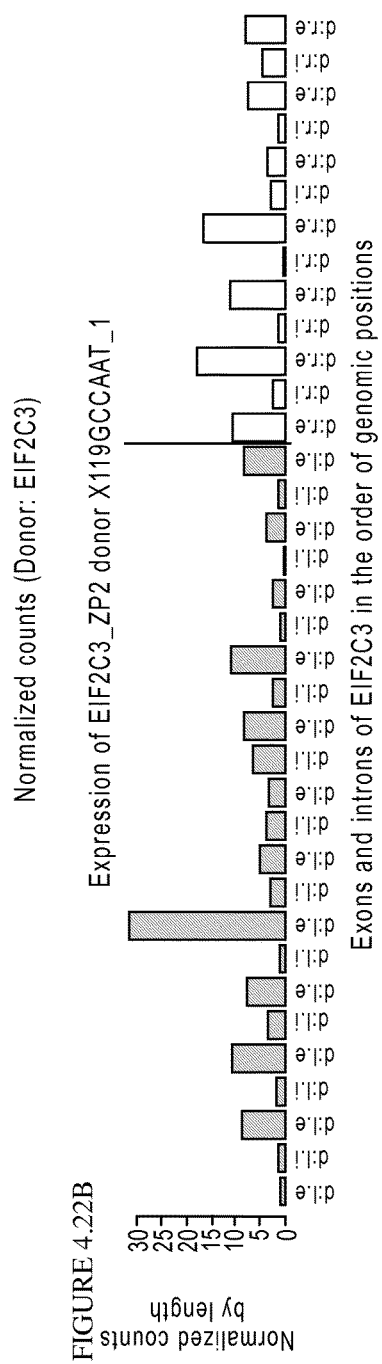
FIGURE 4.22B
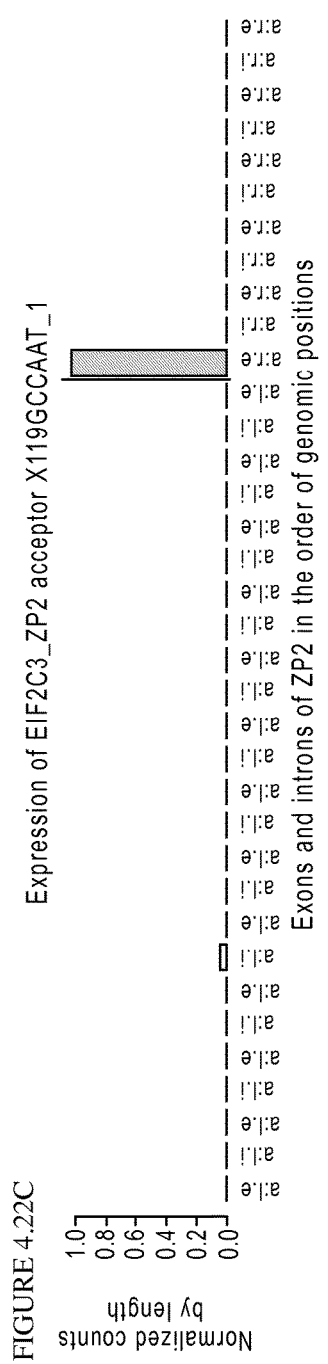
FIGURE 4.22C

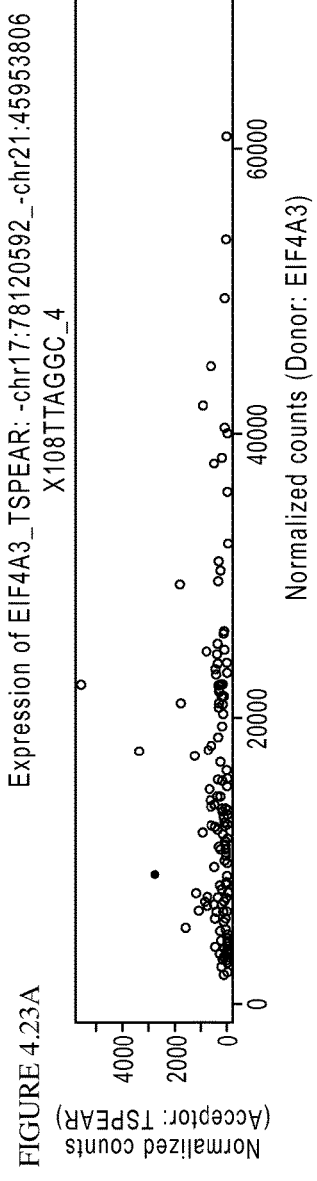
FIGURE 4.23A
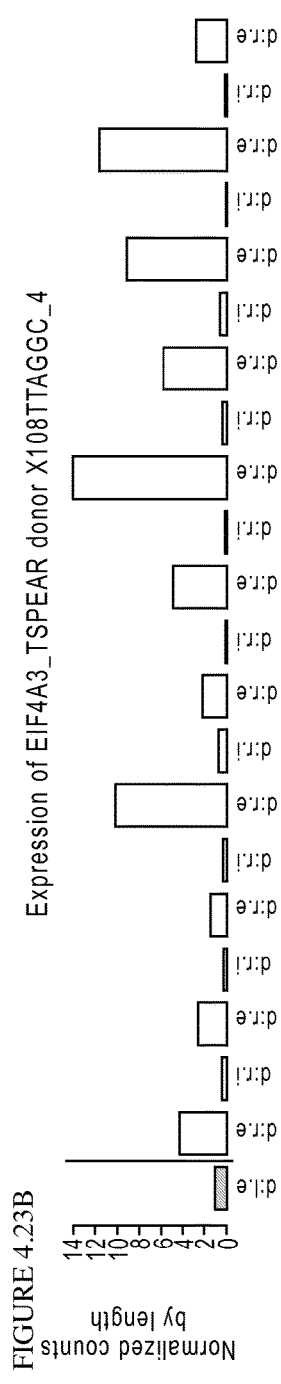
FIGURE 4.23B
FIGURE 4.23C

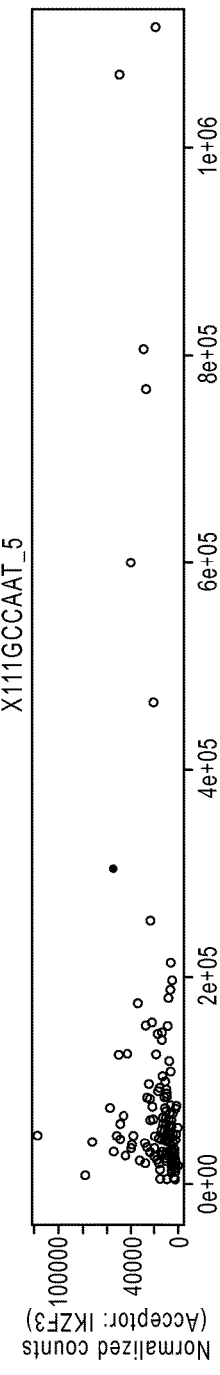
FIGURE 4.24A
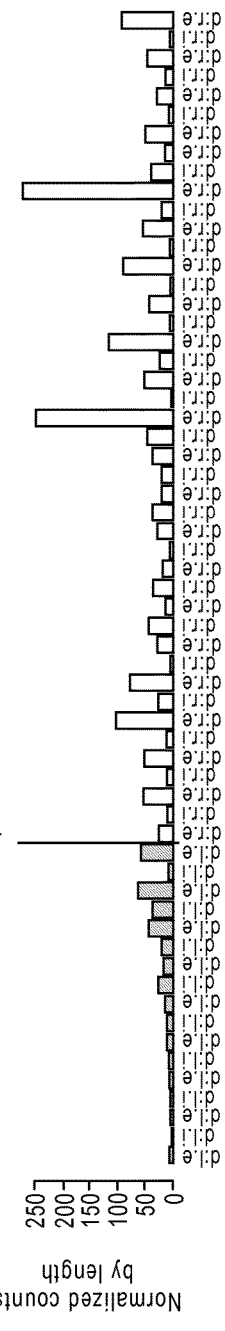
FIGURE 4.24B
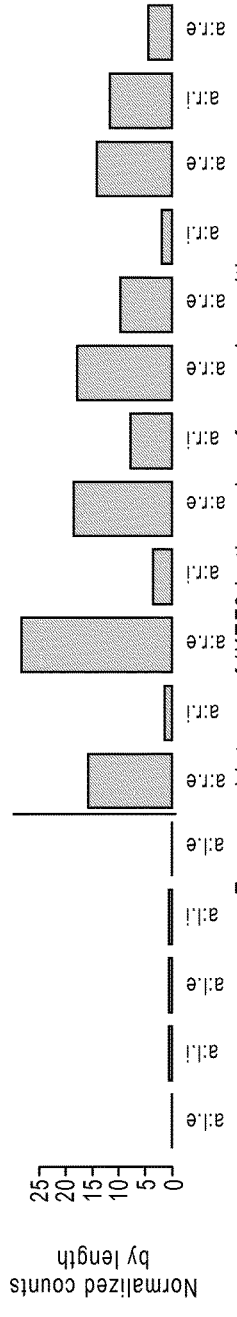
FIGURE 4.24C

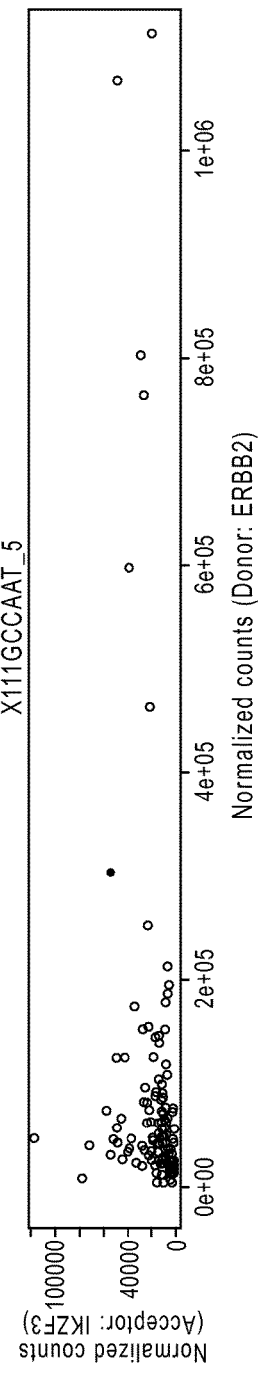
FIGURE 4.25A
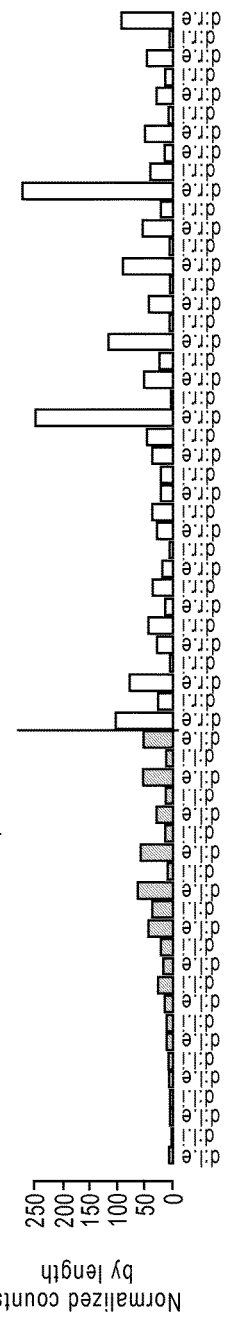
FIGURE 4.25B
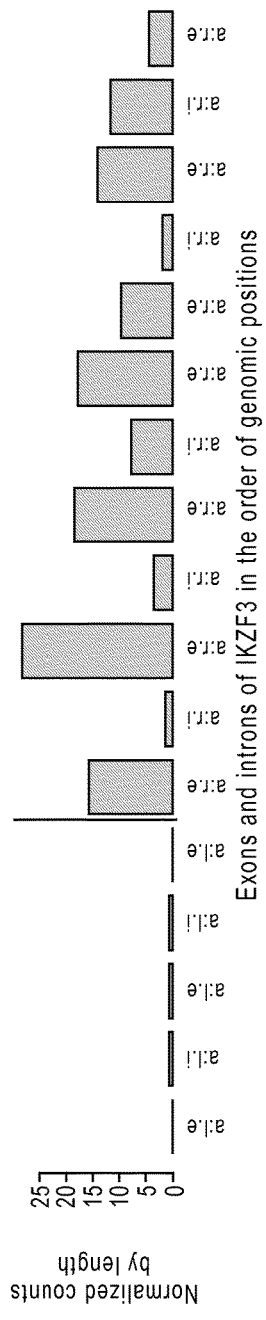
FIGURE 4.25C

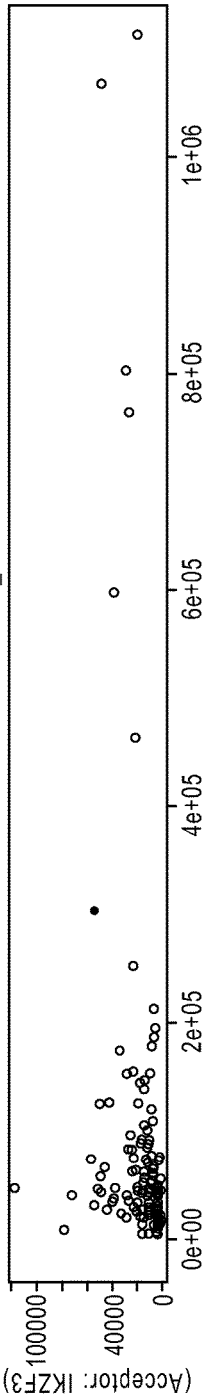
FIGURE 4.26A
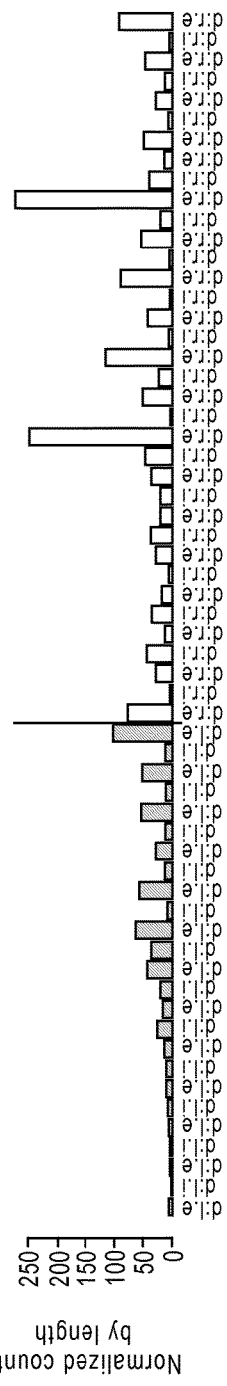
FIGURE 4.26B
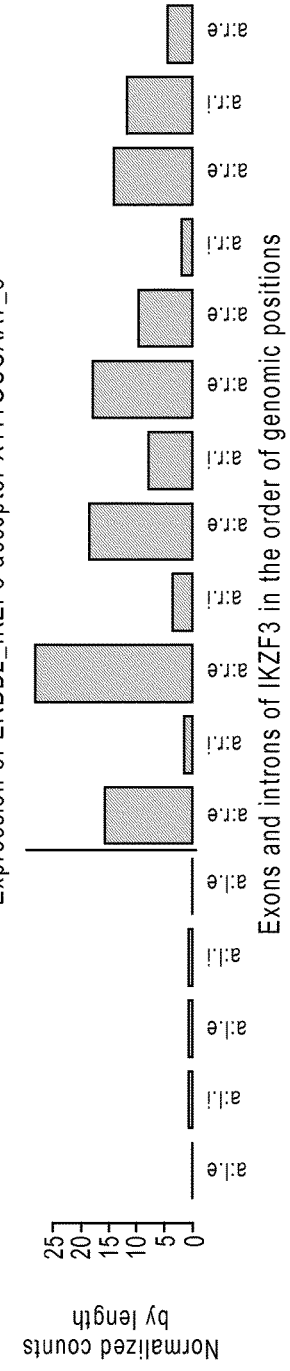
FIGURE 4.26C

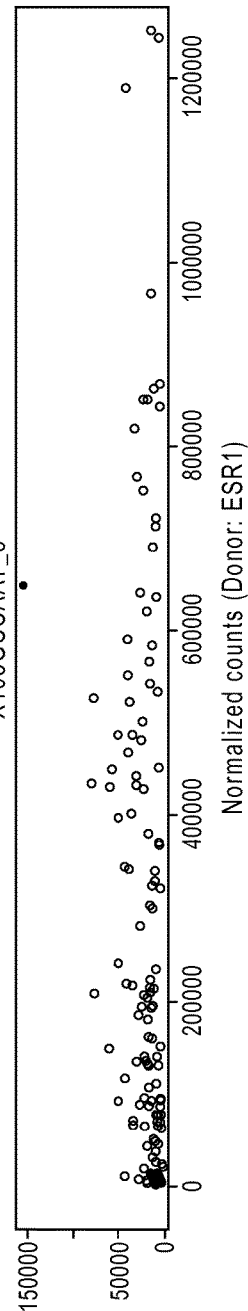
FIGURE 4.27A
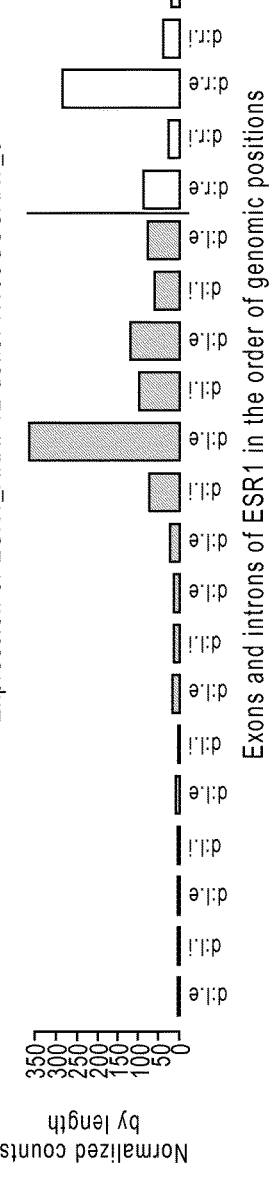
FIGURE 4.27B
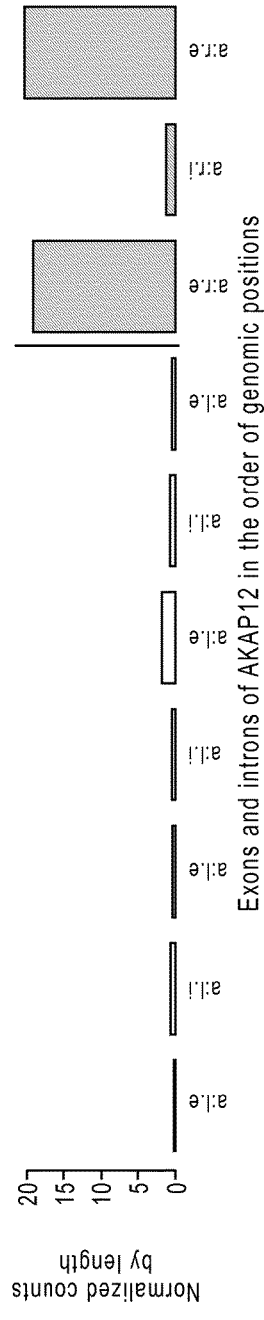
FIGURE 4.27C

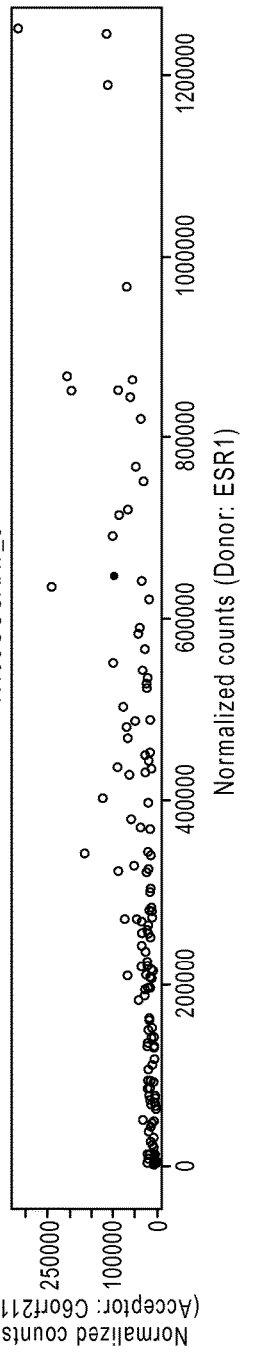
FIGURE 4.28A
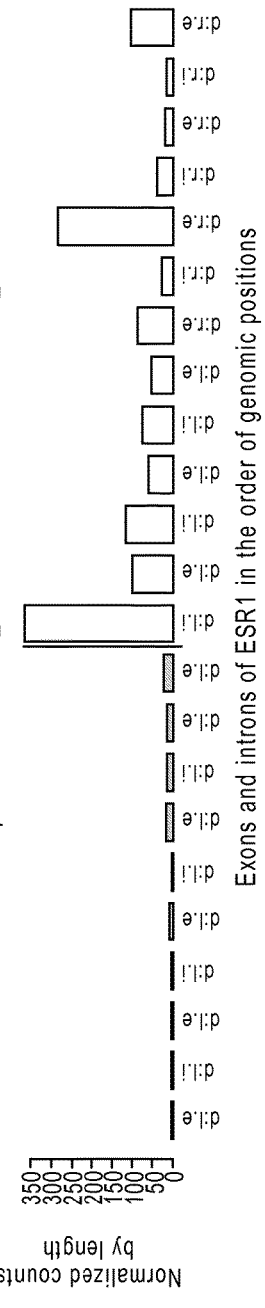
FIGURE 4.28B
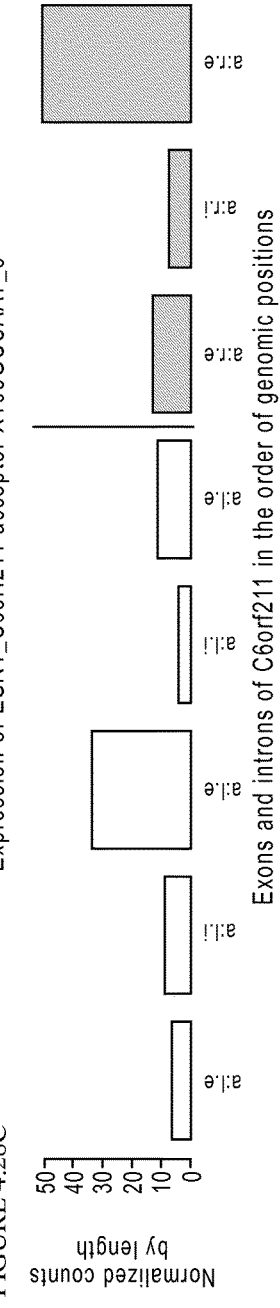
FIGURE 4.28C

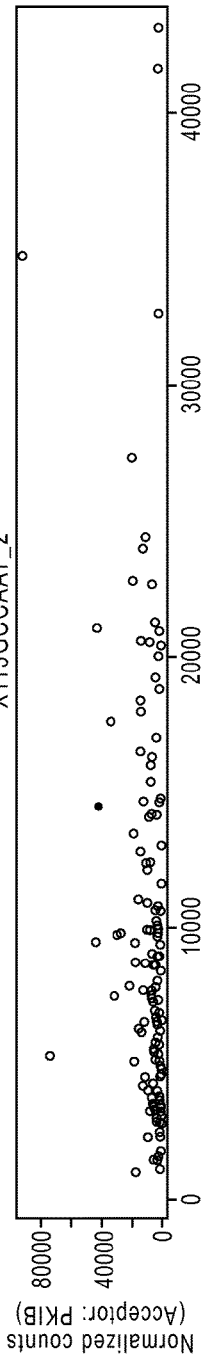
FIGURE 4.29A
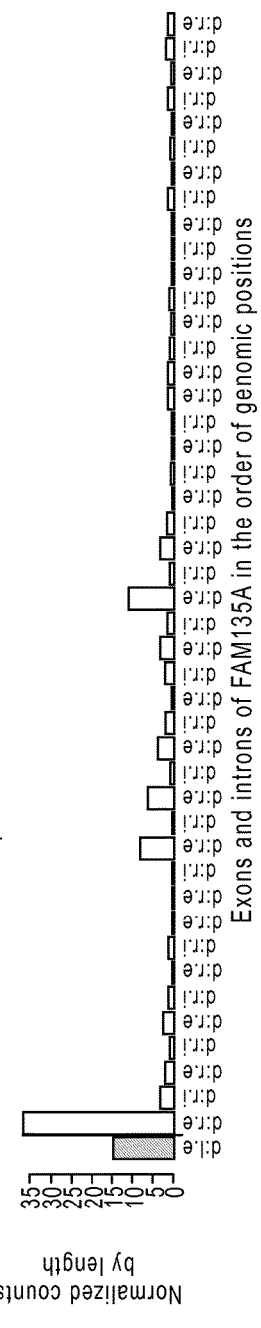
FIGURE 4.29B
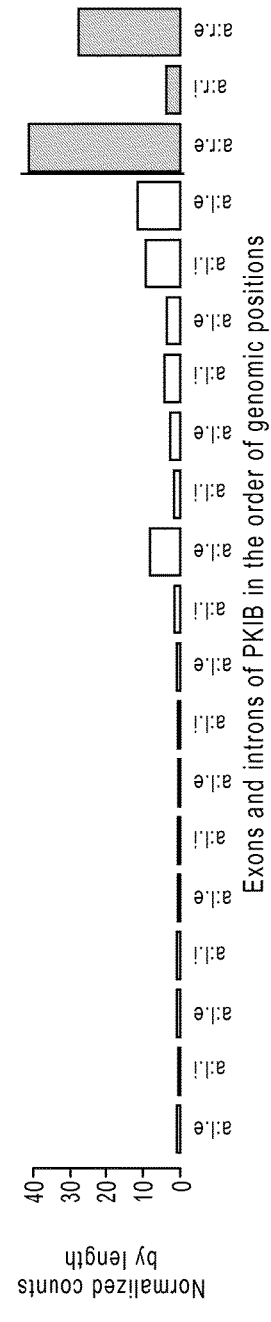
FIGURE 4.29C

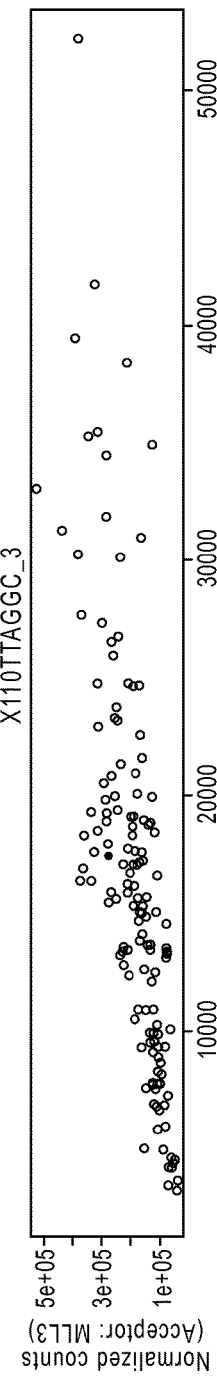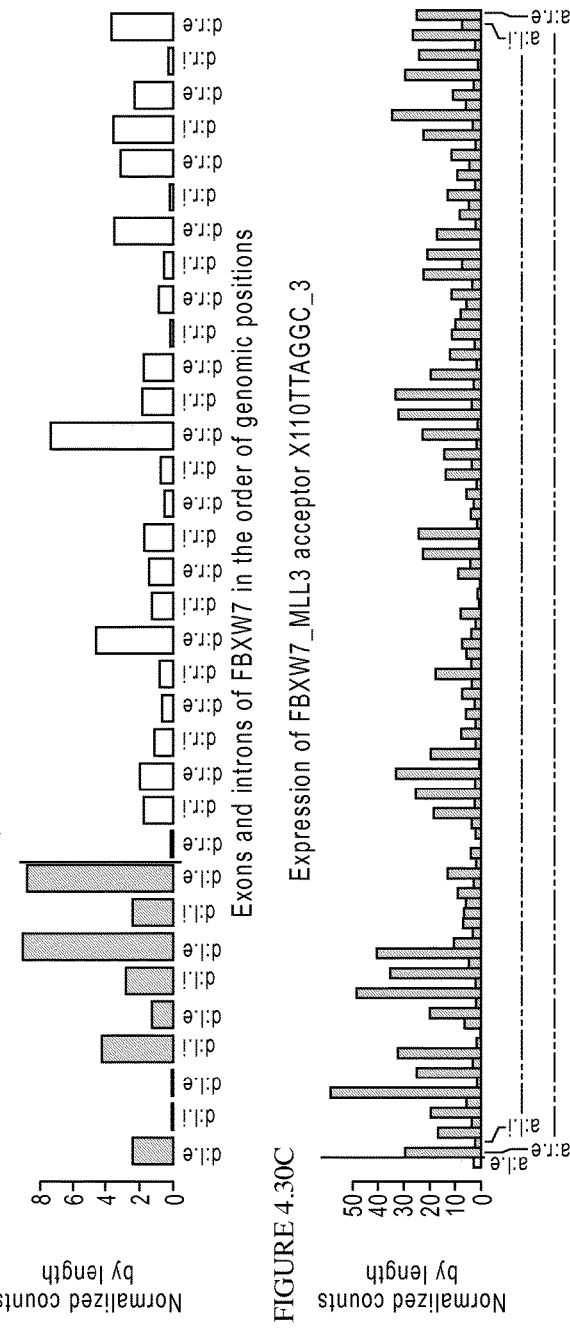
FIGURE 4.30A
FIGURE 4.30B
FIGURE 4.30C

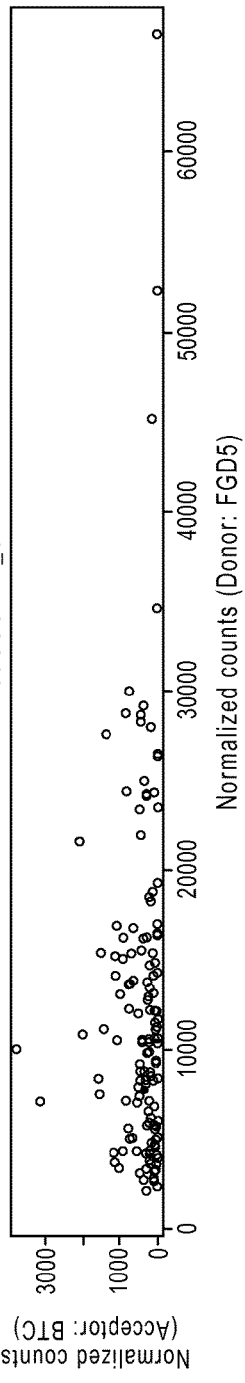
FIGURE 4.31A
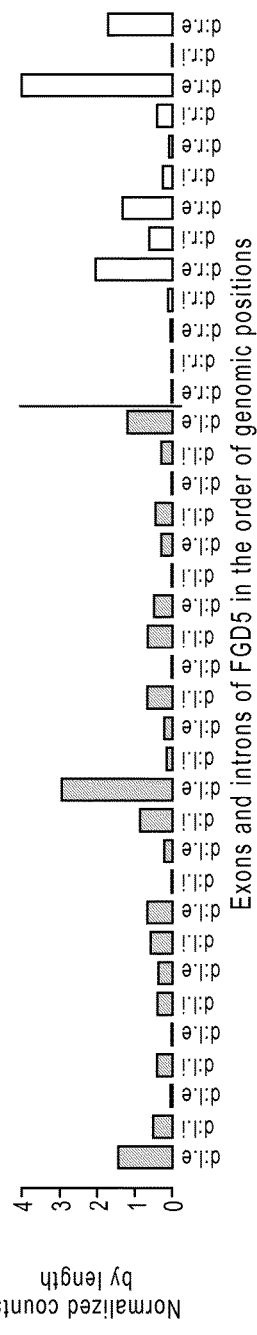
FIGURE 4.31B
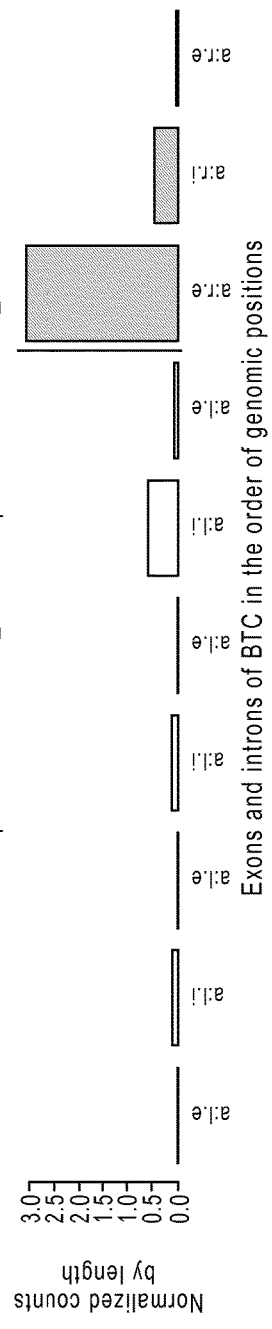
FIGURE 4.31C

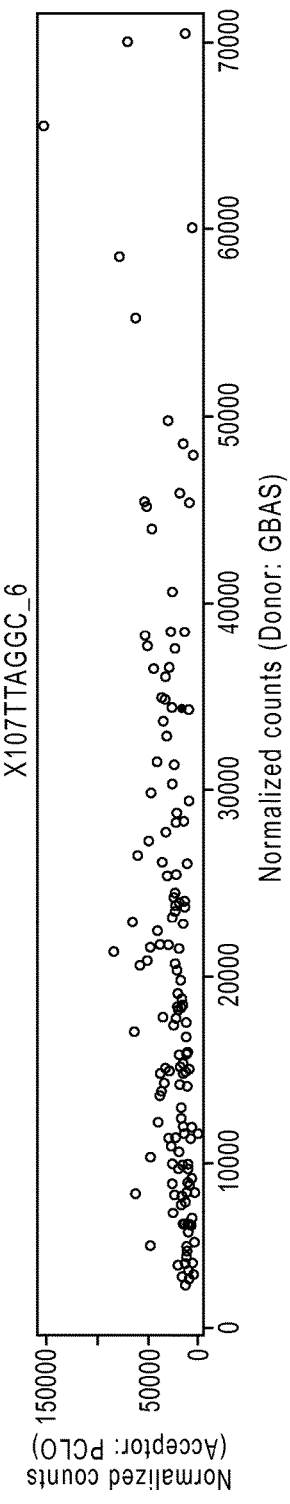
FIGURE 4.32A
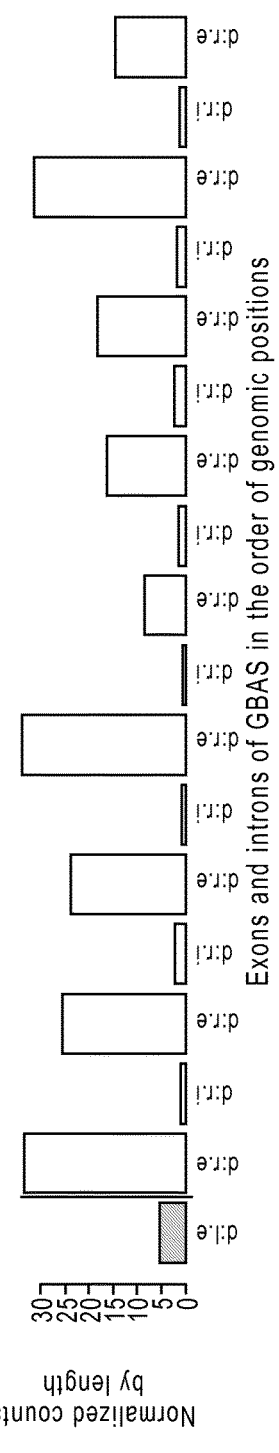
FIGURE 4.32B
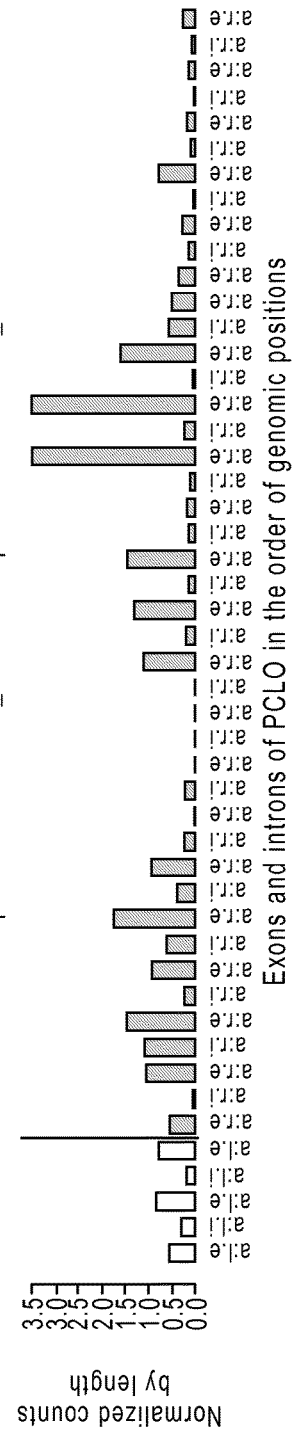
FIGURE 4.32C

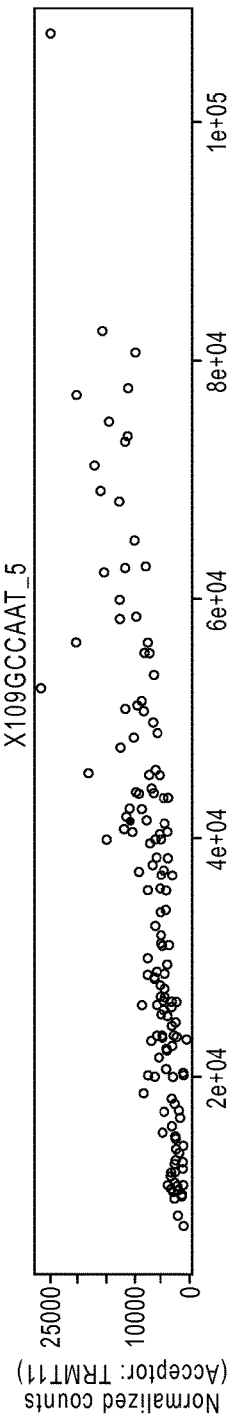
FIGURE 4.33A
FIGURE 4.33B
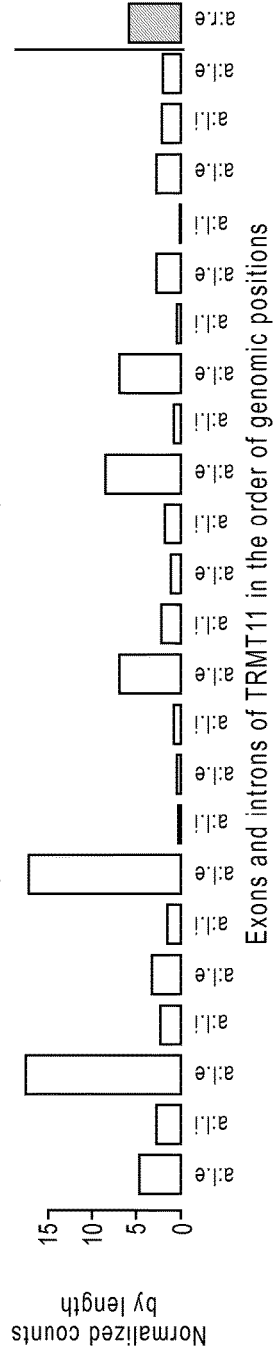
FIGURE 4.33C

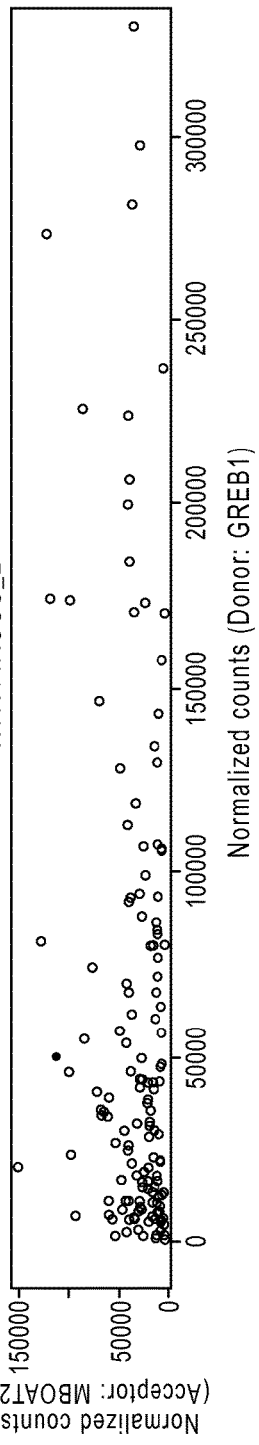
FIGURE 4.34A
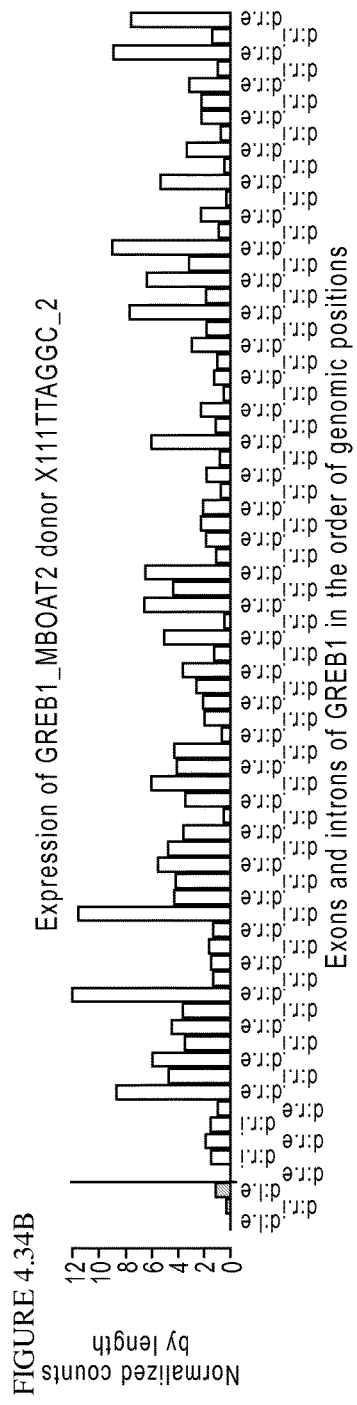
FIGURE 4.34B
FIGURE 4.34C

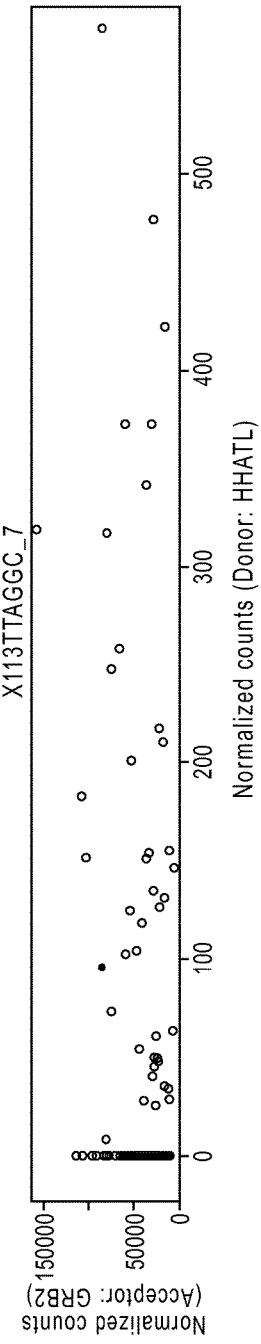
FIGURE 4.35A
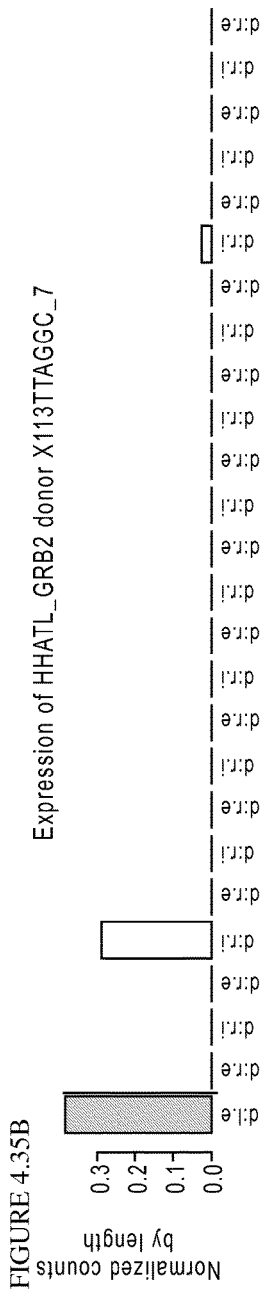
FIGURE 4.35B
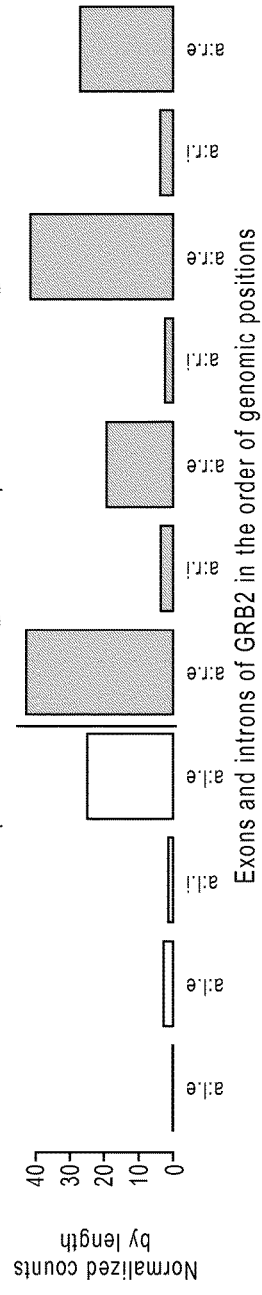
FIGURE 4.35C

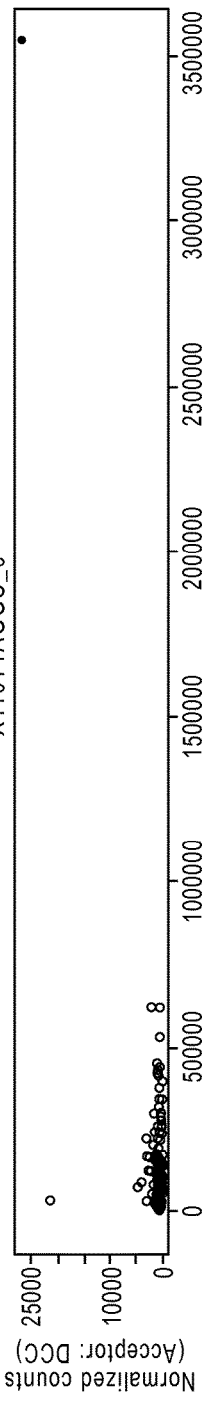
FIGURE 4.36A
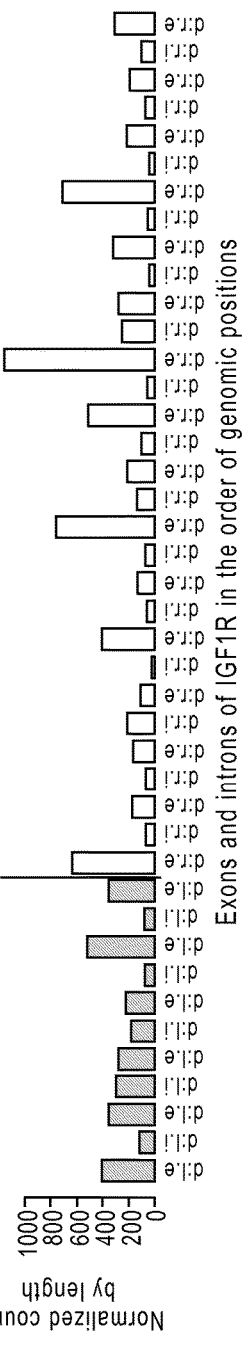
FIGURE 4.36B
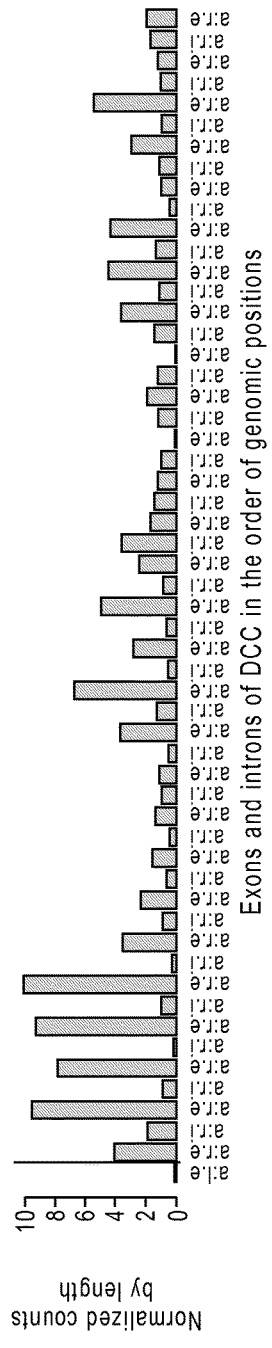
FIGURE 4.36C

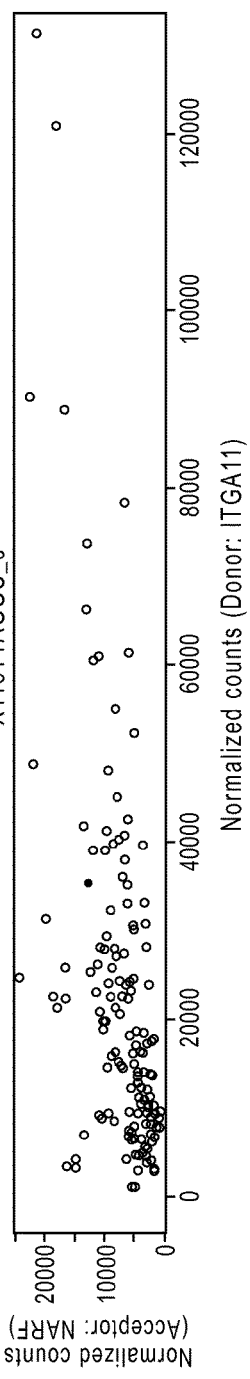
FIGURE 4.37A
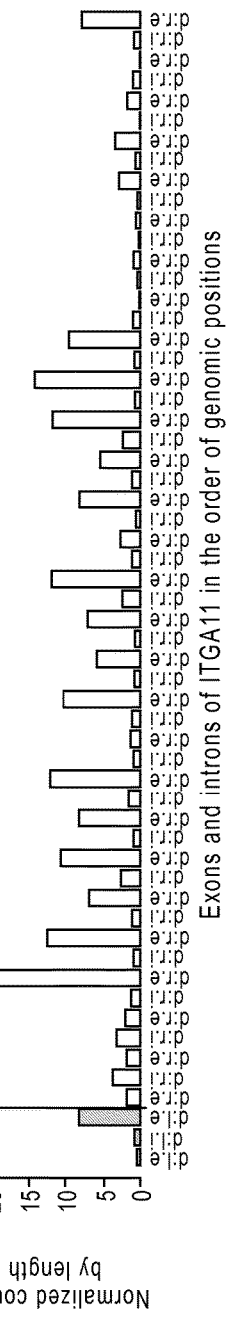
FIGURE 4.37B
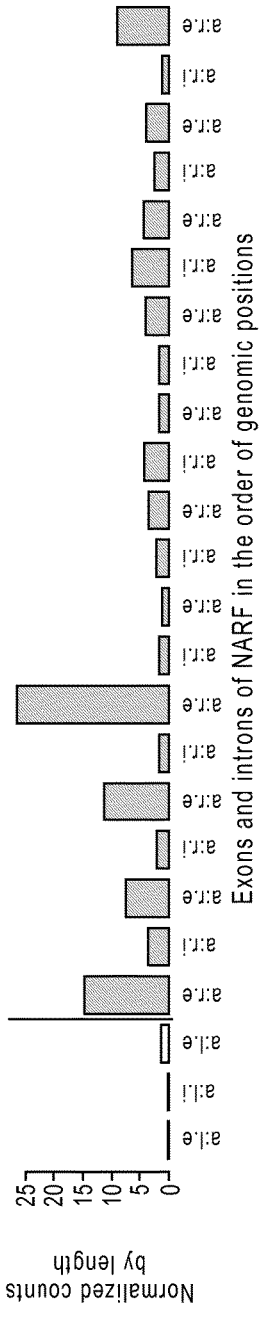
FIGURE 4.37C

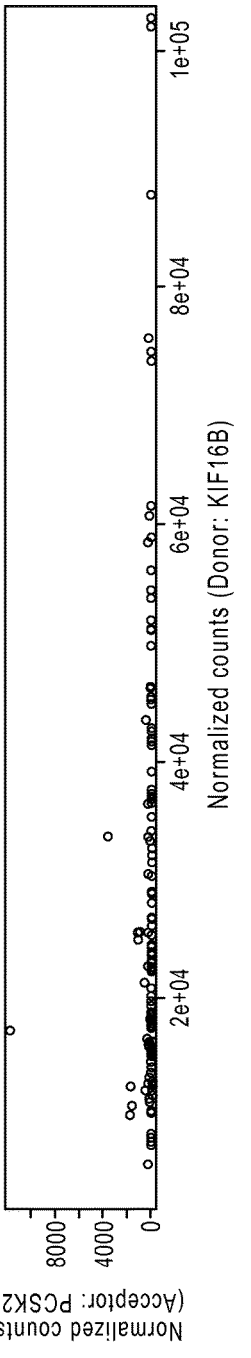
FIGURE 4.38A
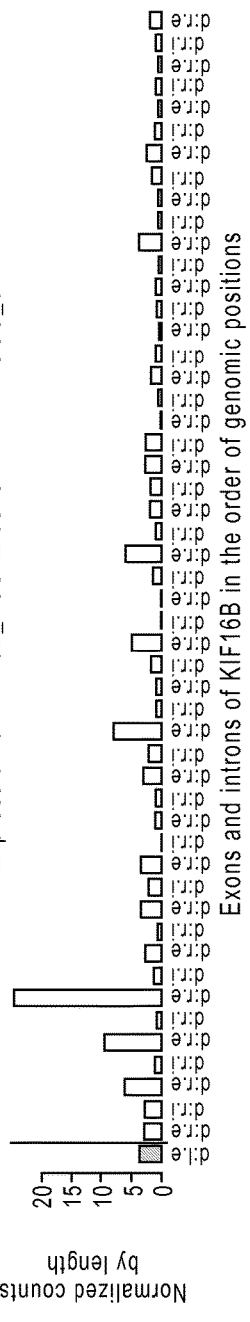
FIGURE 4.38B
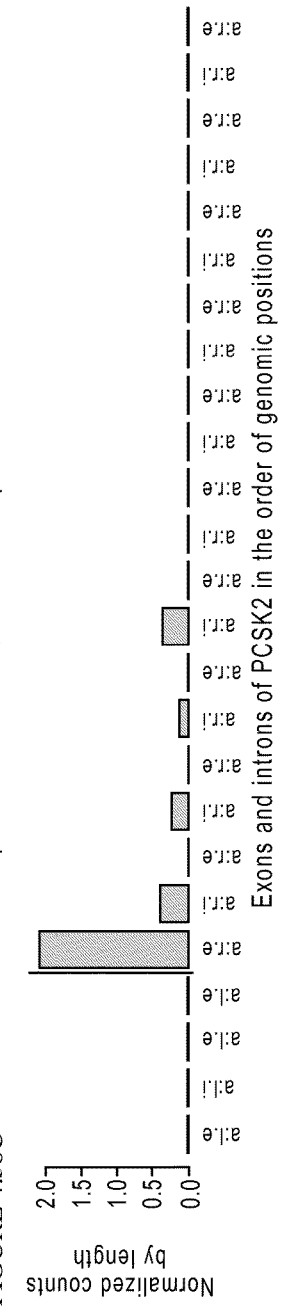
FIGURE 4.38C

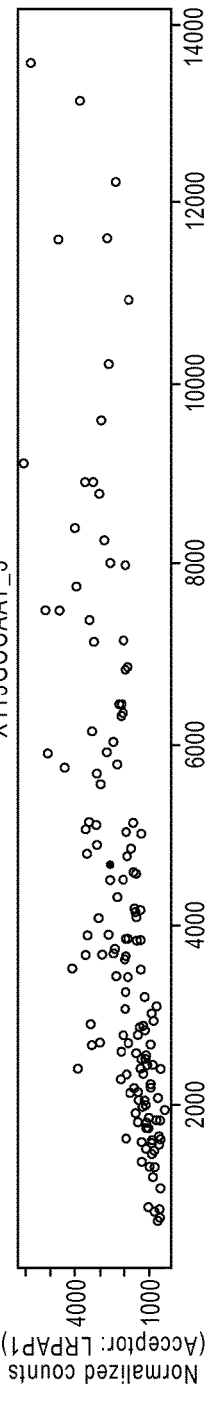
FIGURE 4.39A
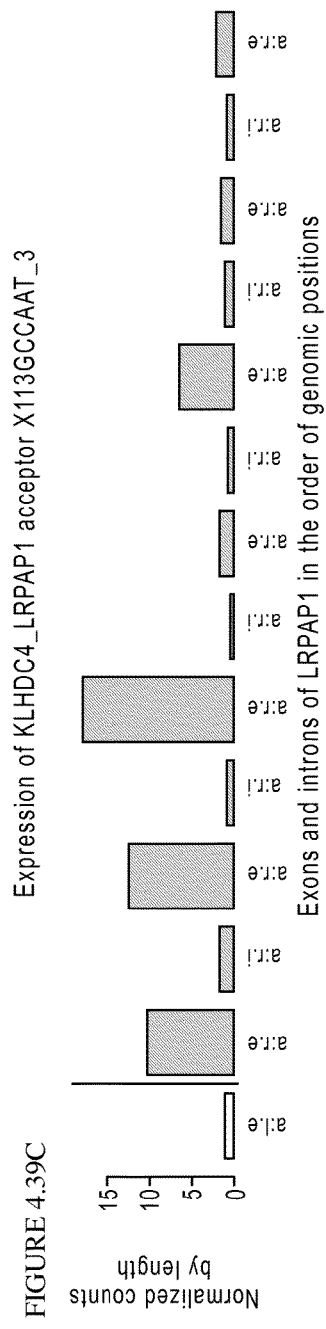
FIGURE 4.39B
FIGURE 4.39C

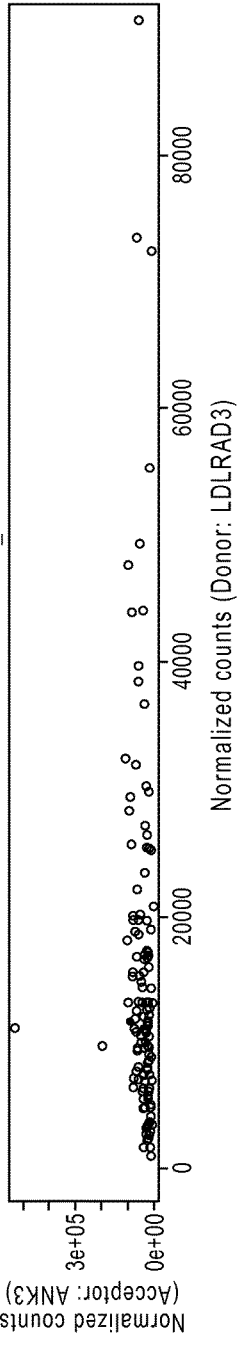
FIGURE 4.40A
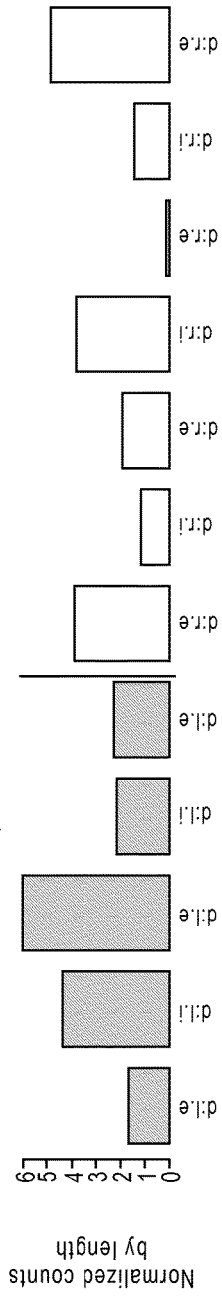
FIGURE 4.40B
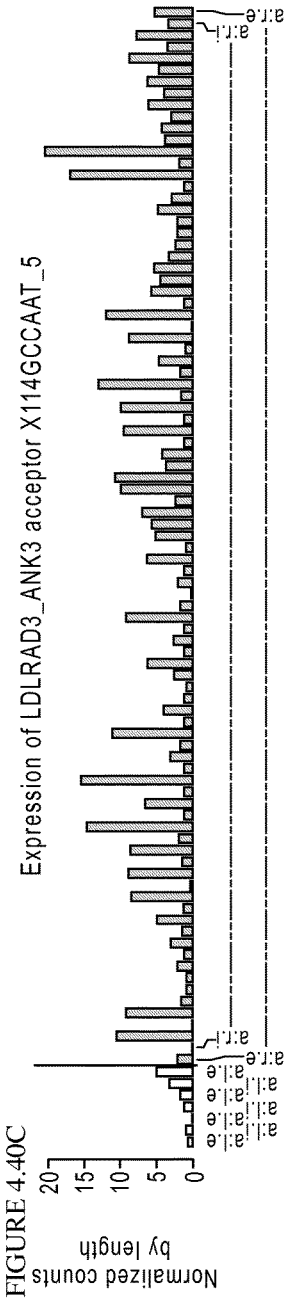
FIGURE 4.40C

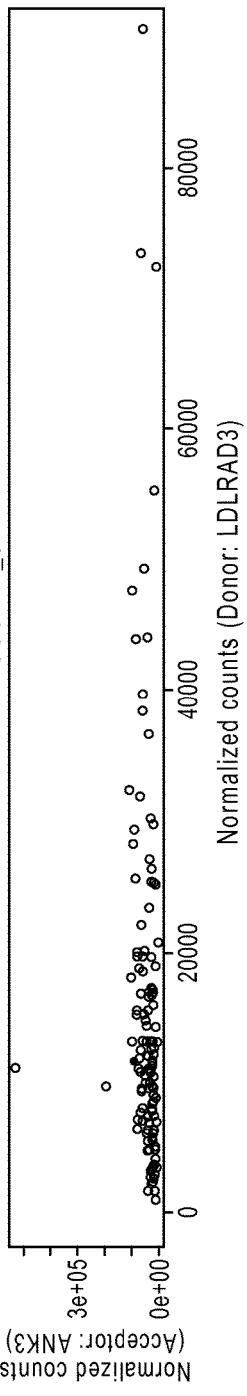
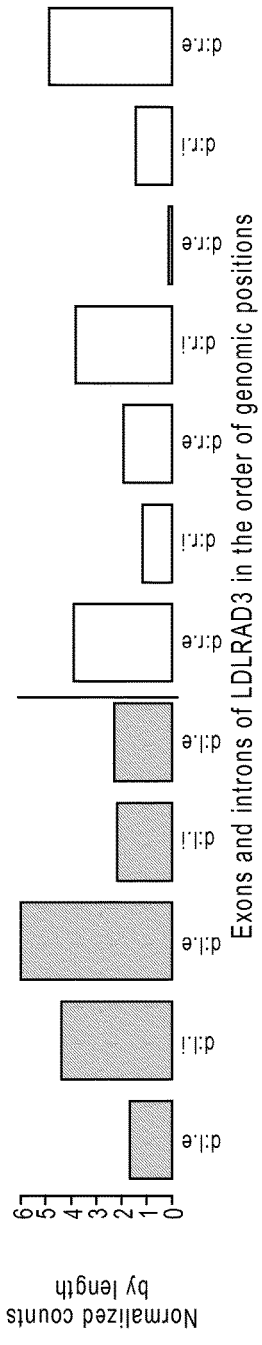
FIGURE 4.41A
FIGURE 4.41B
FIGURE 4.41C

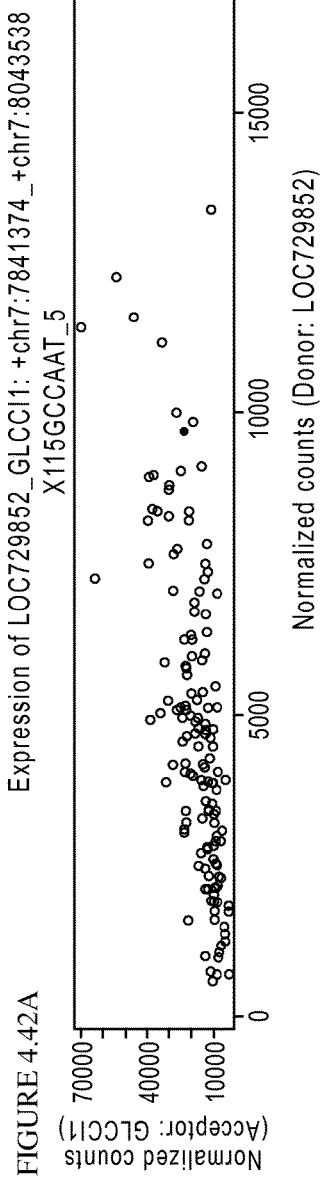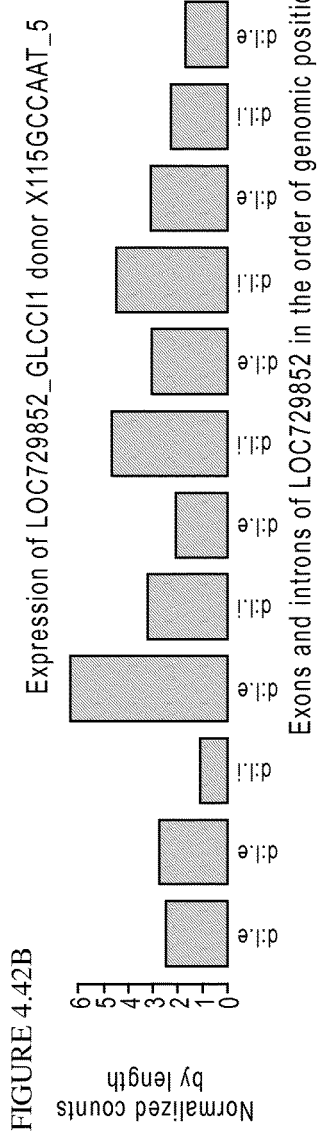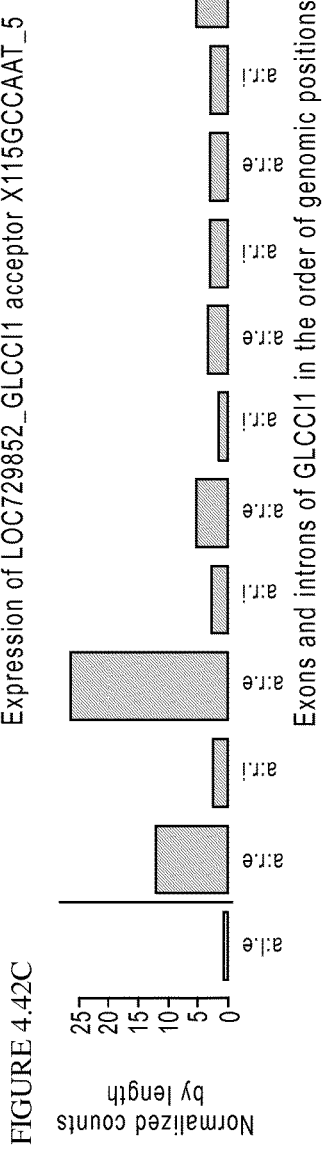

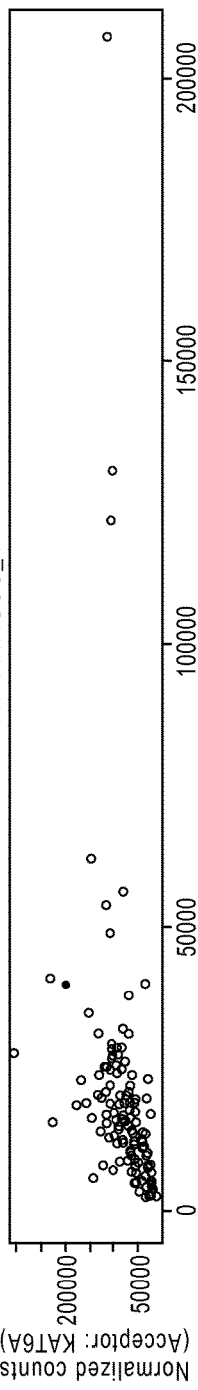
FIGURE 4.43A
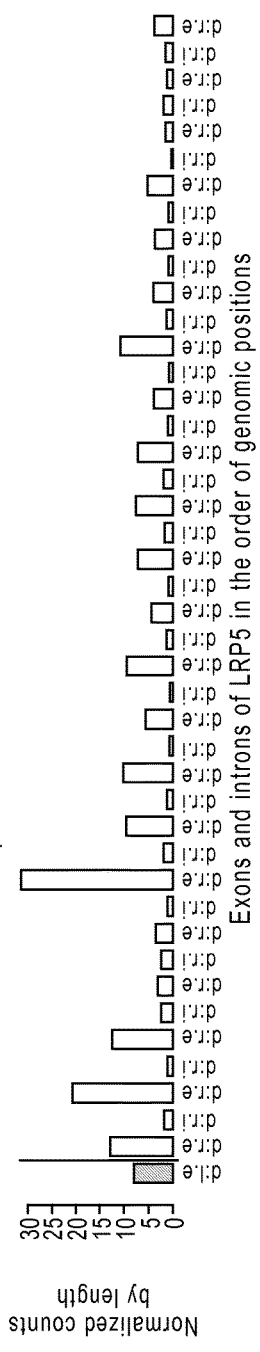
FIGURE 4.43B
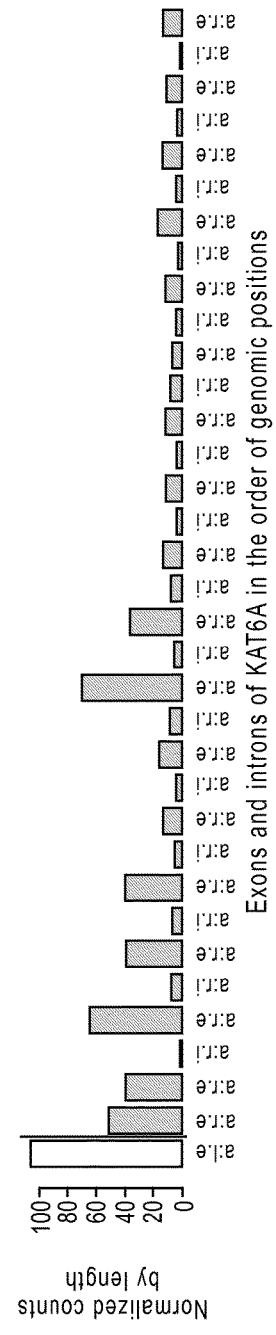
FIGURE 4.43C

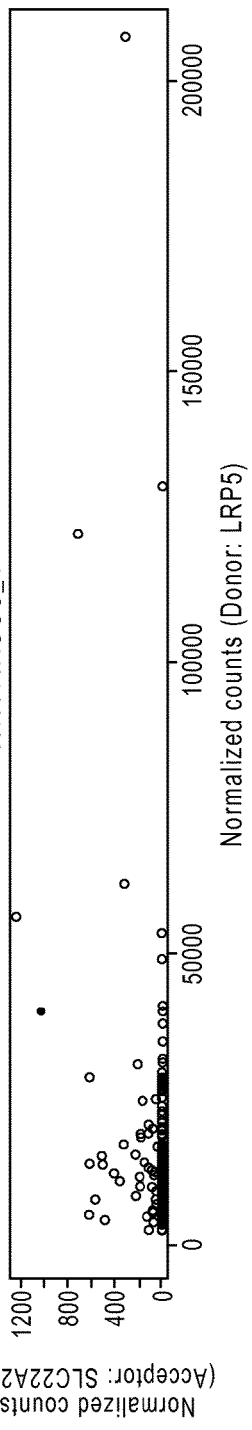
FIGURE 4.44A
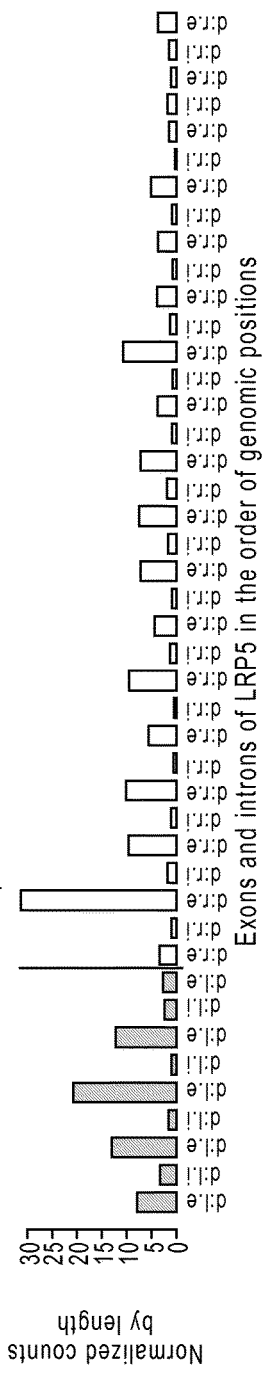
FIGURE 4.44B
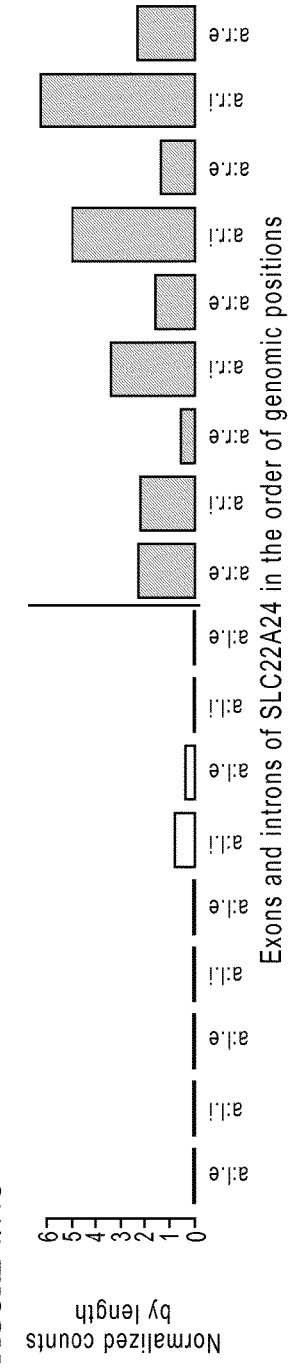
FIGURE 4.44C

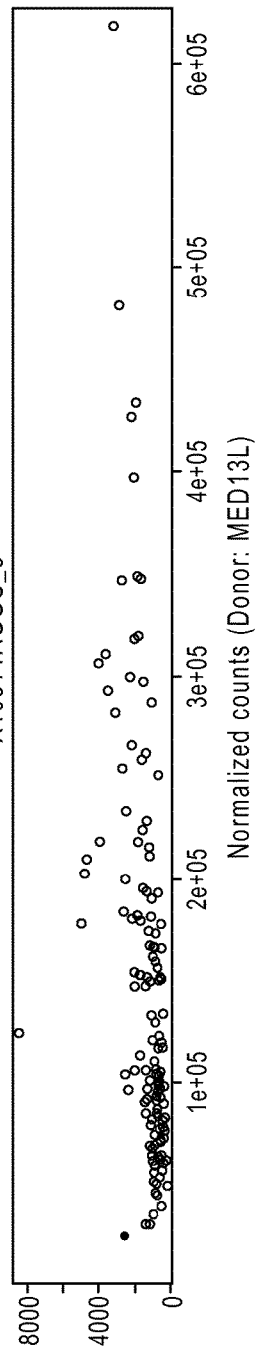
FIGURE 4.45A
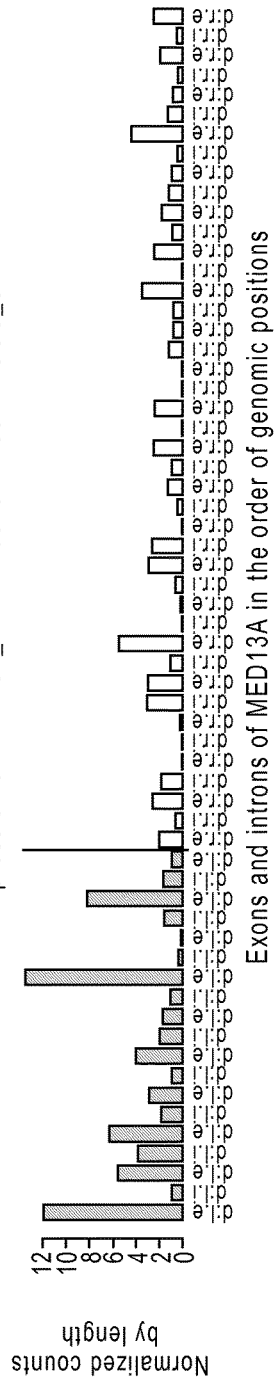
FIGURE 4.45B
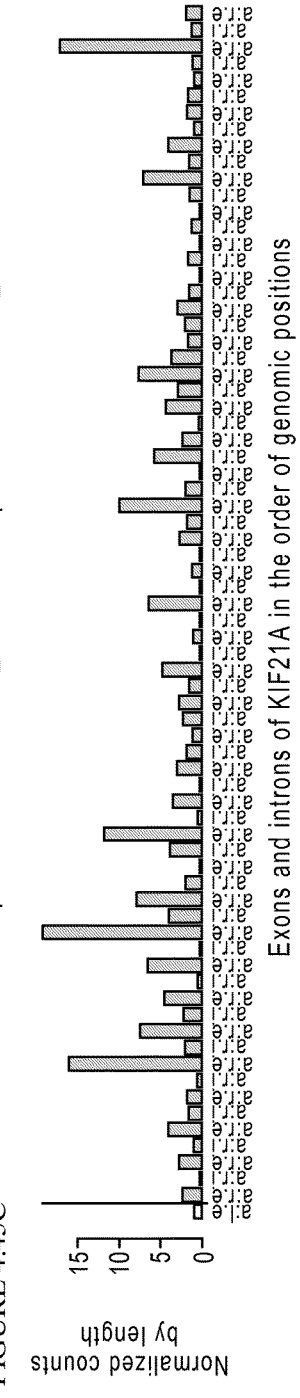
FIGURE 4.45C

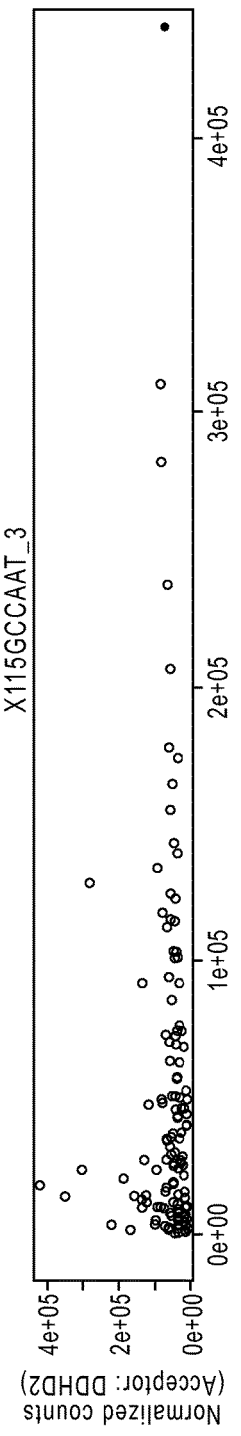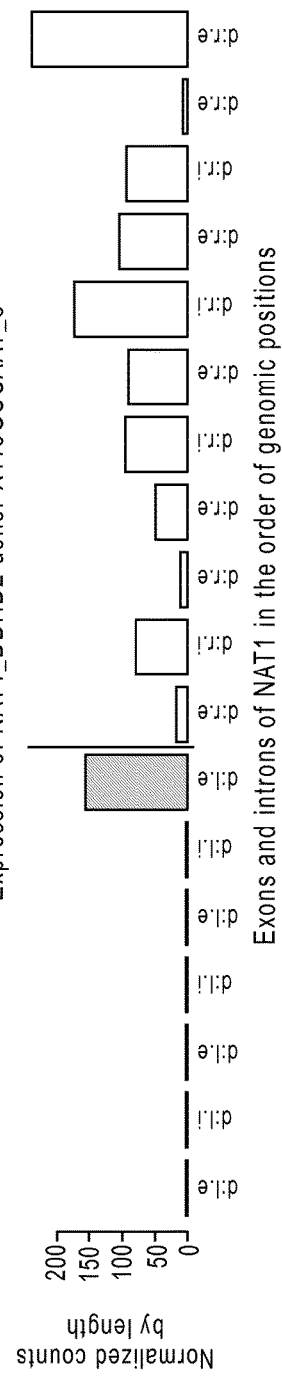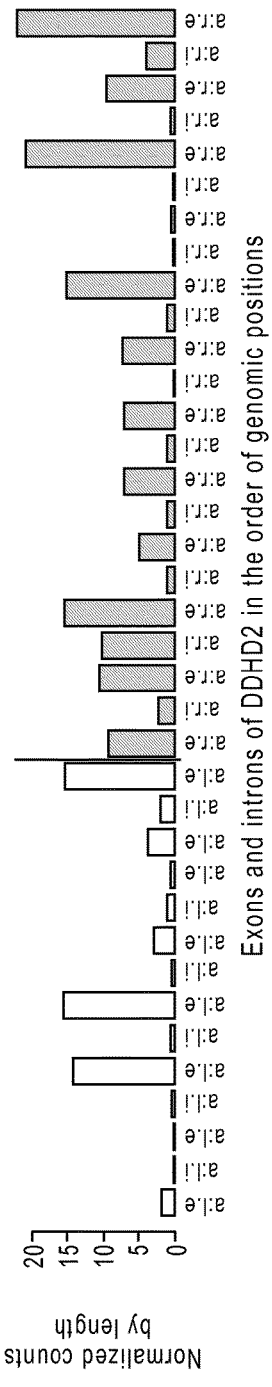
FIGURE 4.46A  FIGURE 4.46B  FIGURE 4.46C

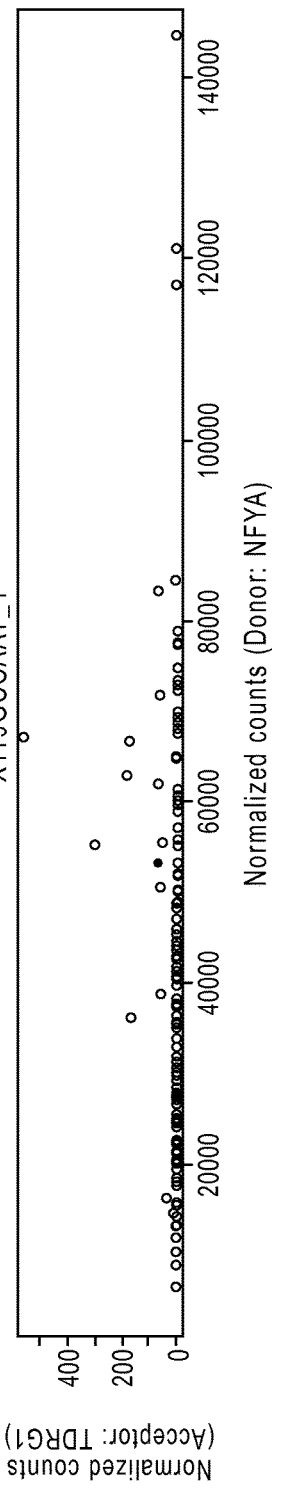
FIGURE 4.47A
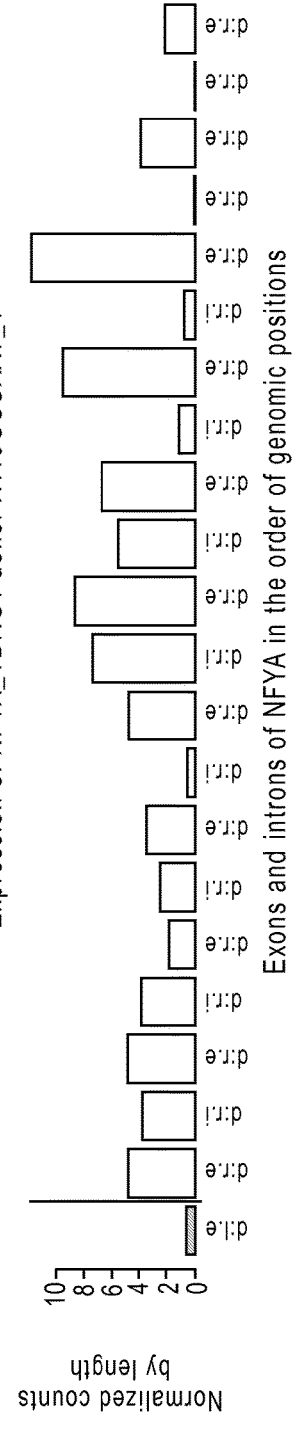
FIGURE 4.47B
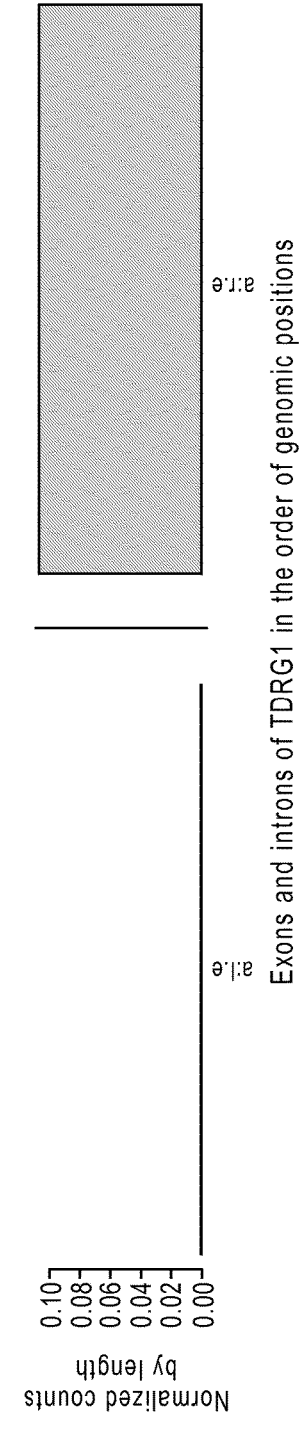
FIGURE 4.47C

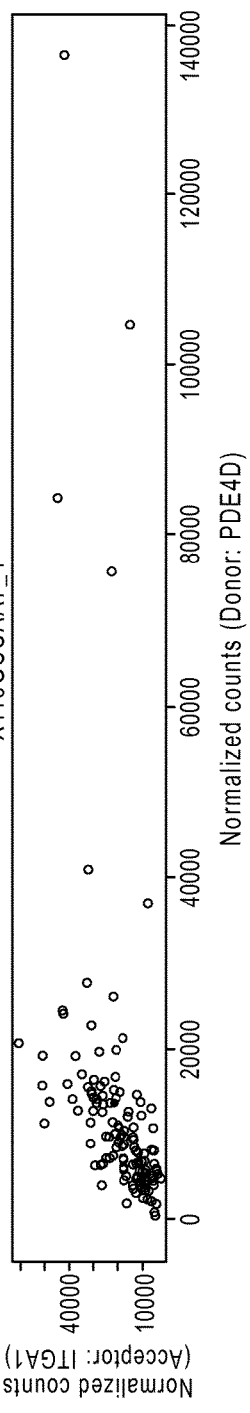
FIGURE 4.48A
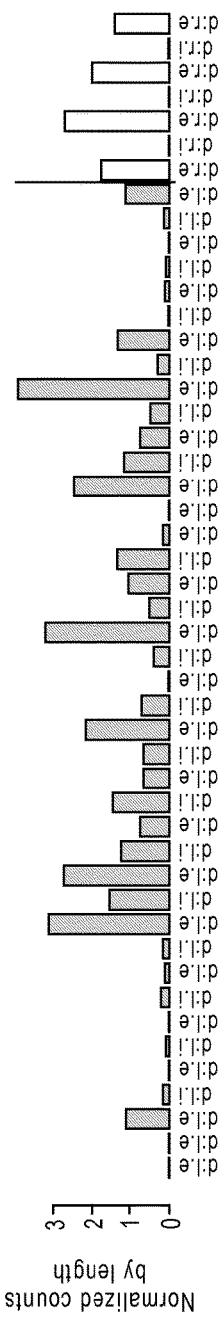
FIGURE 4.48B
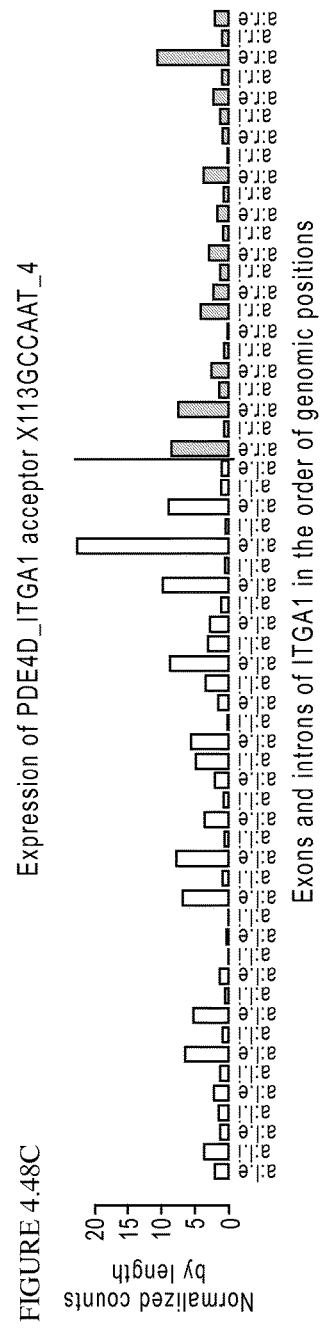
FIGURE 4.48C

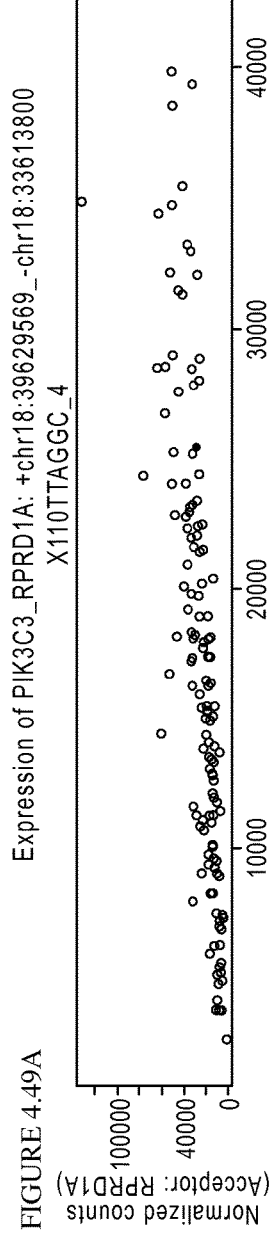
FIGURE 4.49A
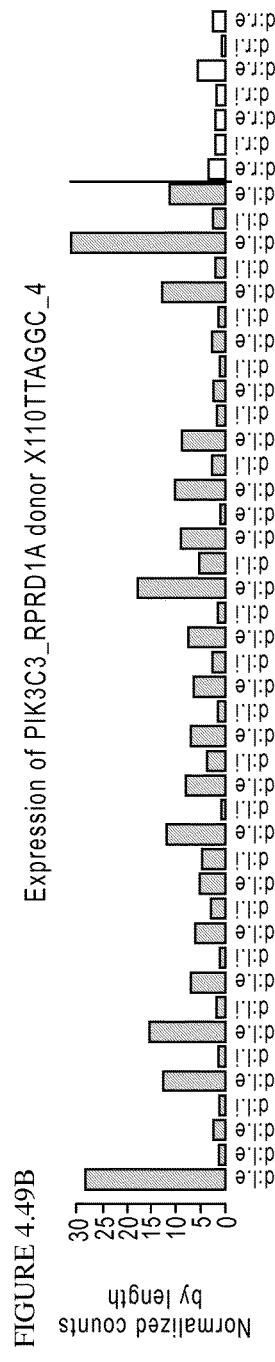
FIGURE 4.49B
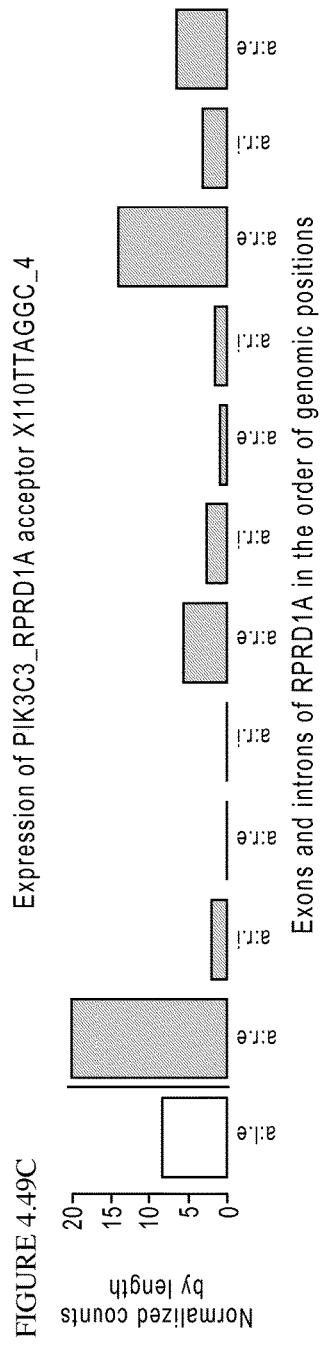
FIGURE 4.49C

FIGURE 4.50A
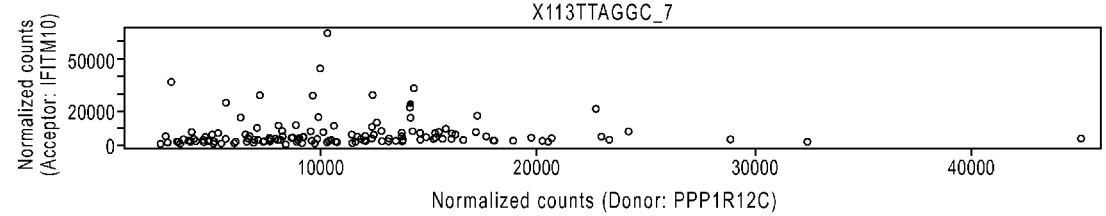
FIGURE 4.50B
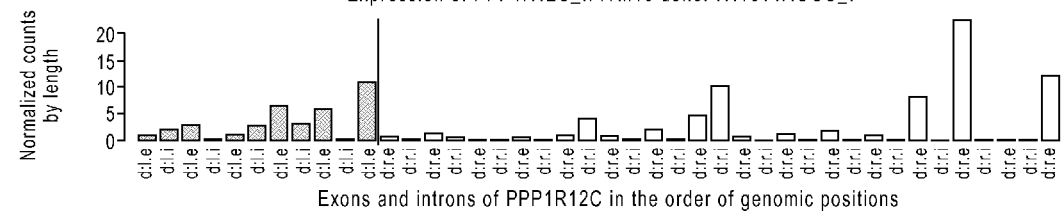
FIGURE 4.50C
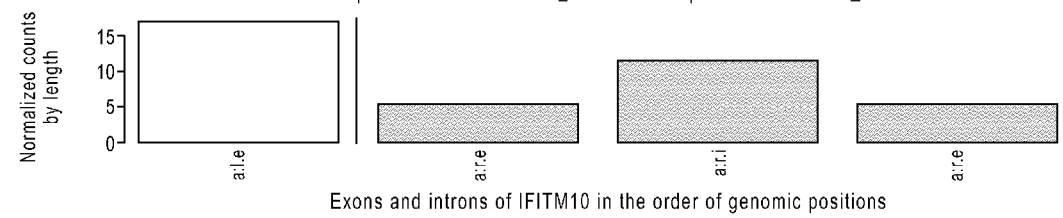

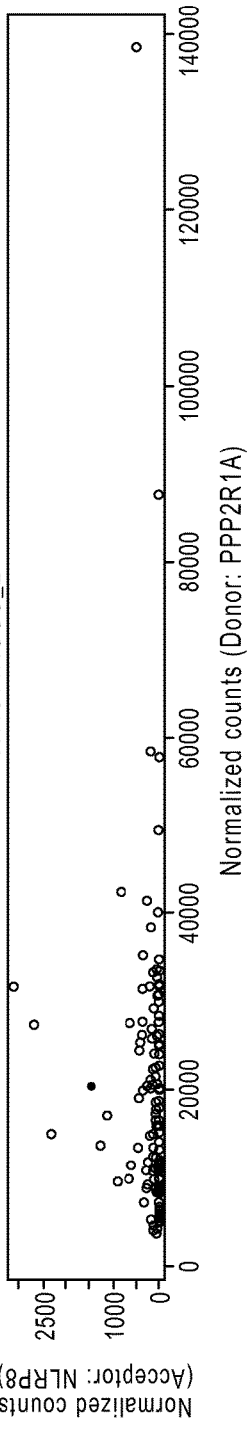
FIGURE 4.51A
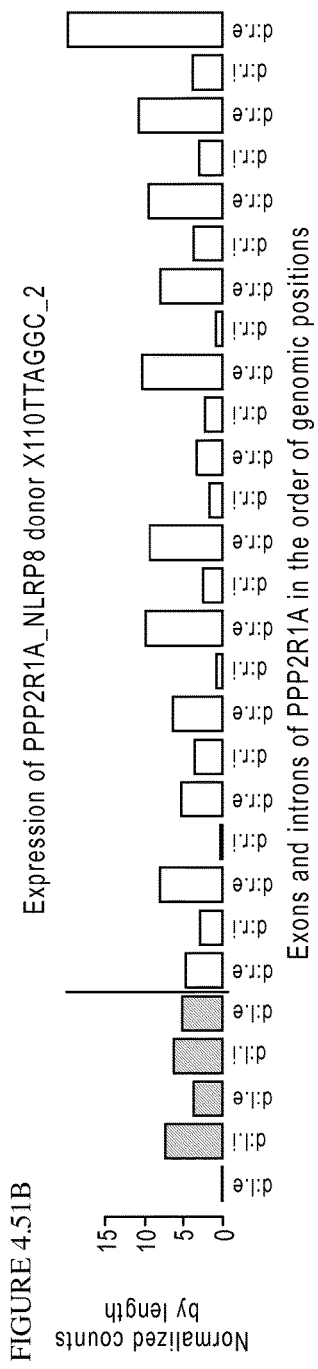
FIGURE 4.51B
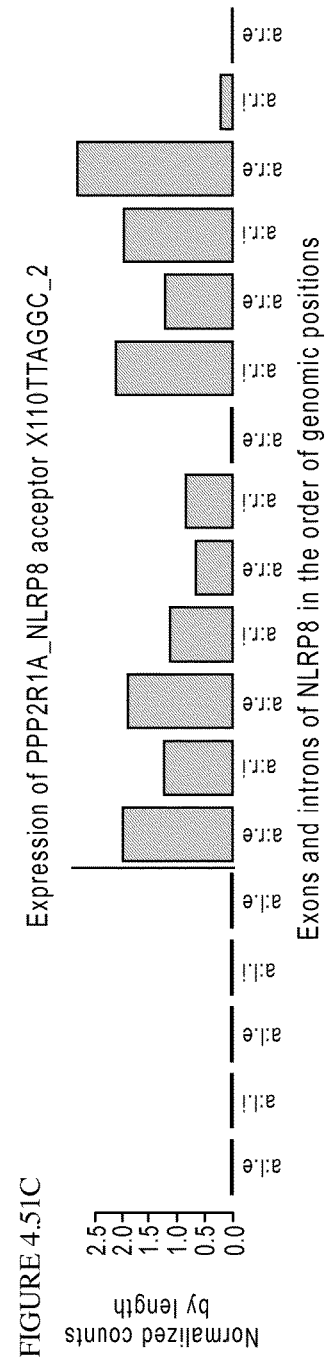
FIGURE 4.51C

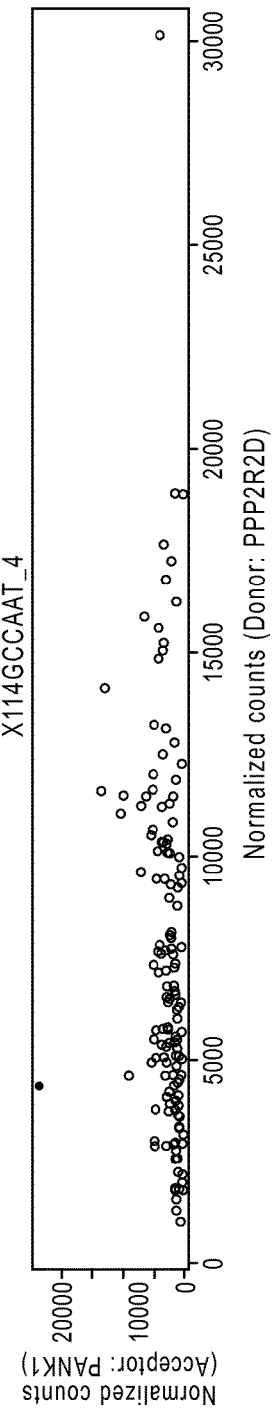
FIGURE 4.52A
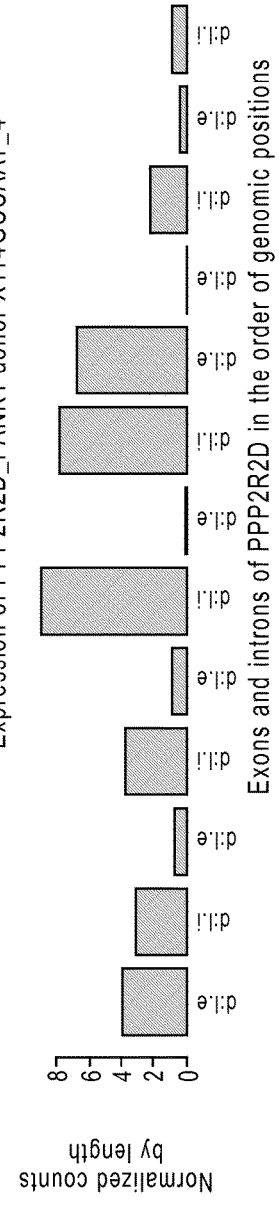
FIGURE 4.52B
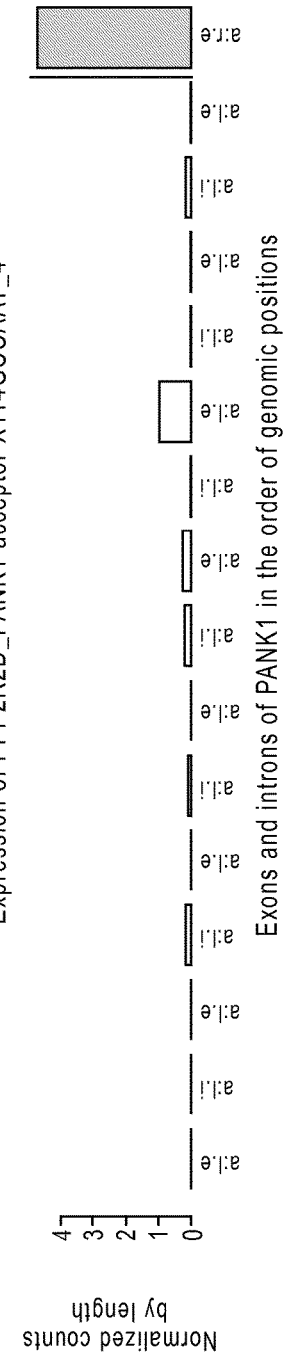
FIGURE 4.52C

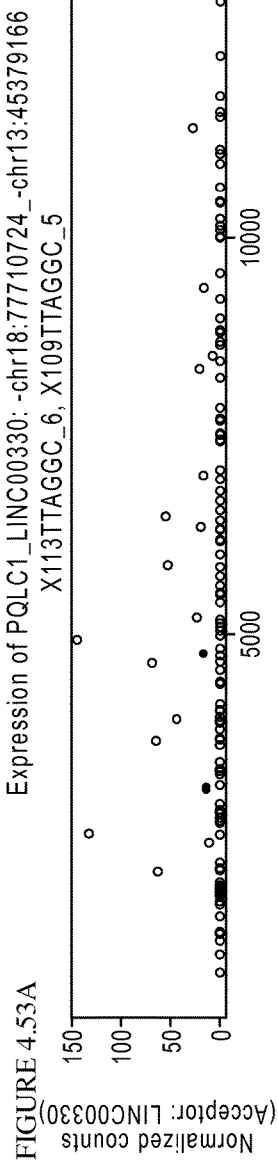
FIGURE 4.53A
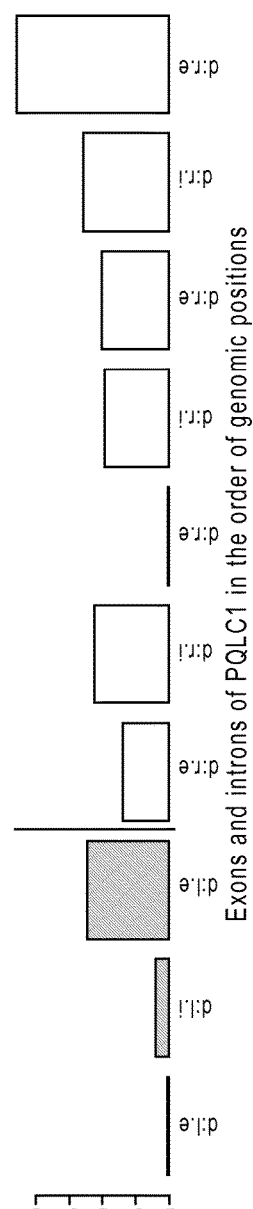
FIGURE 4.53B
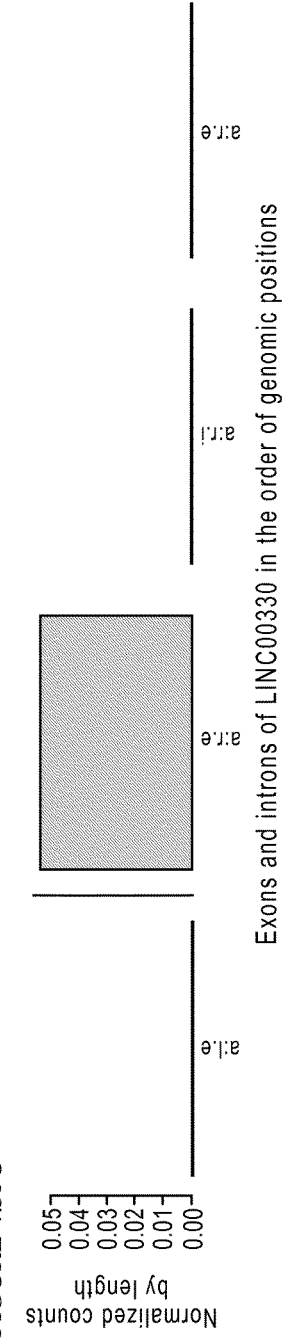
FIGURE 4.53C

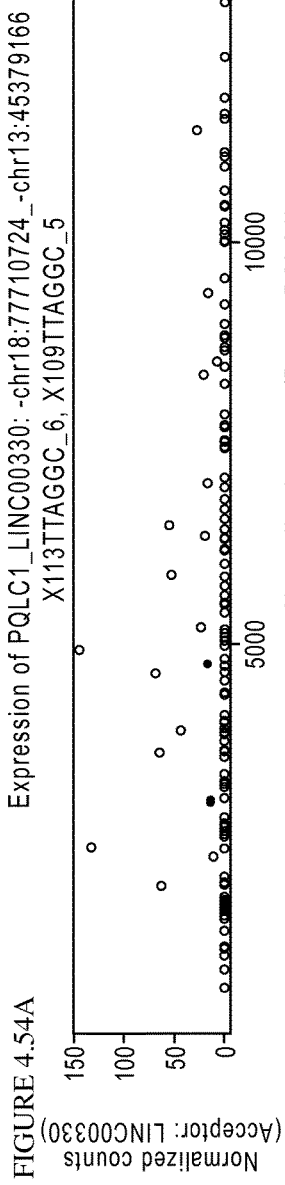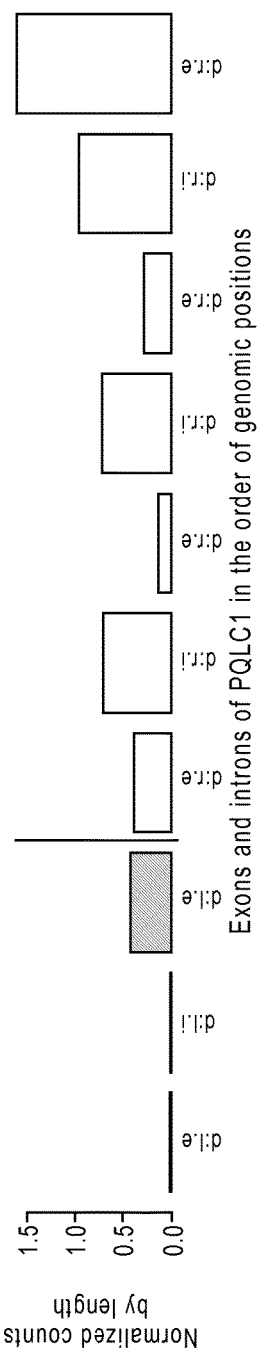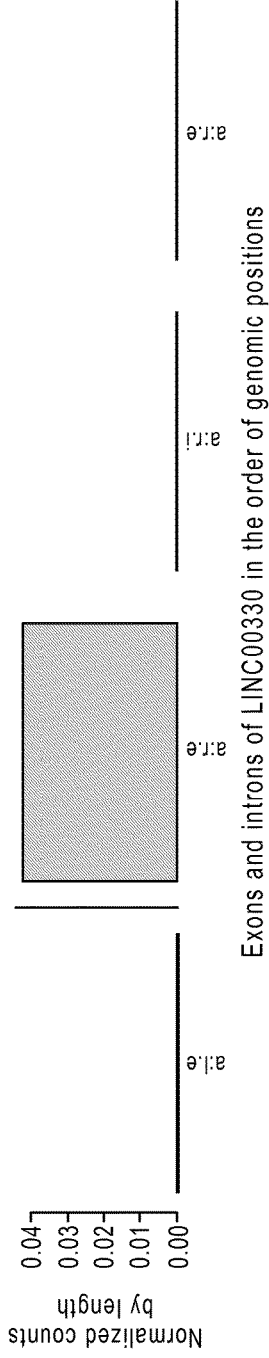
FIGURE 4.54A
FIGURE 4.54B
FIGURE 4.54C

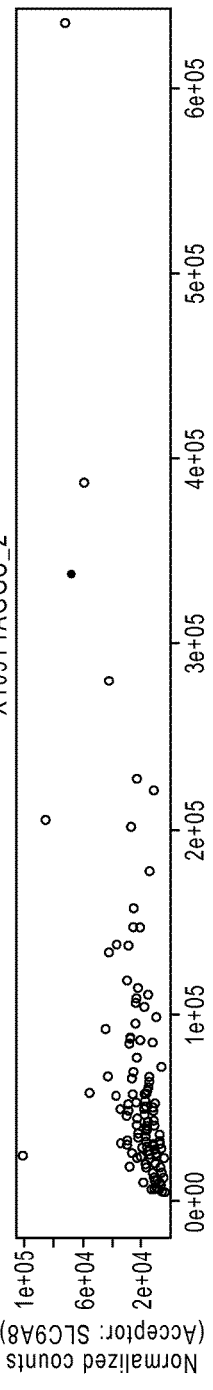
FIGURE 4.55A
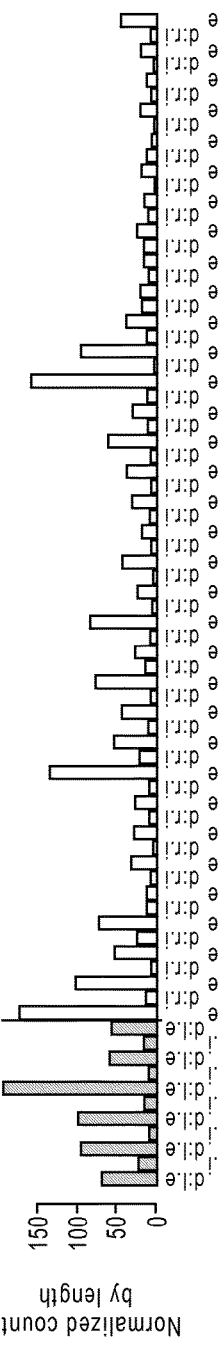
FIGURE 4.55B
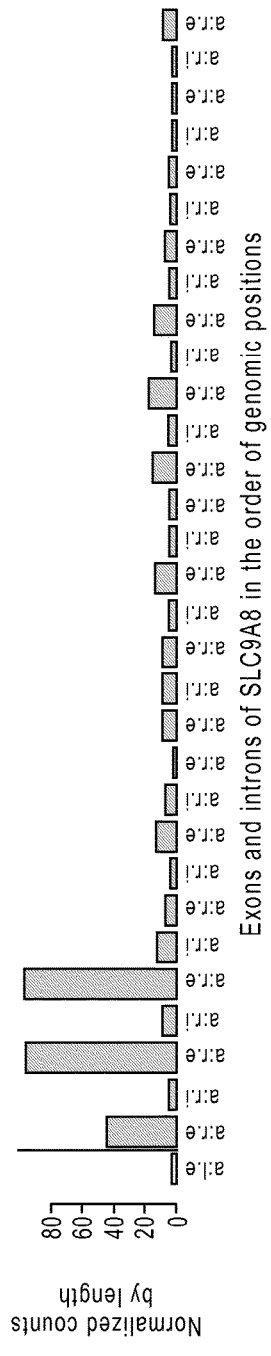
FIGURE 4.55C

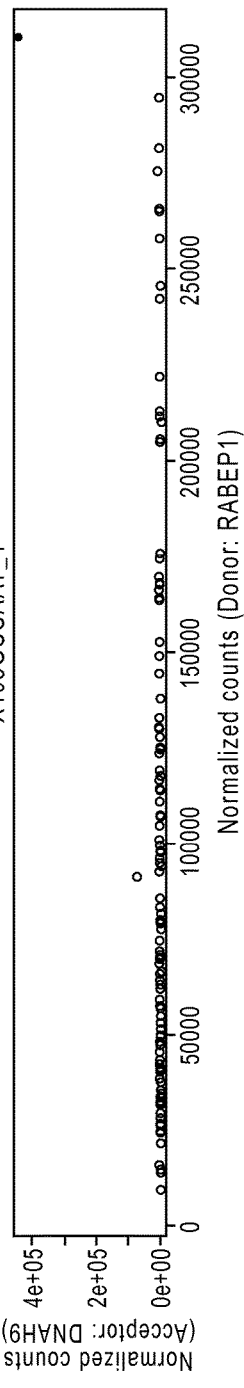
FIGURE 4.56A
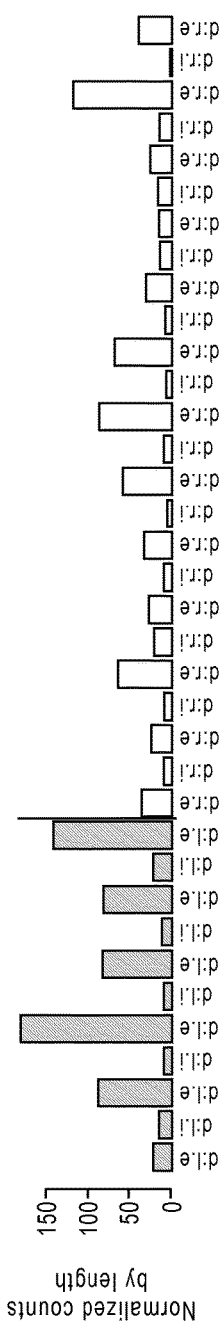
FIGURE 4.56B
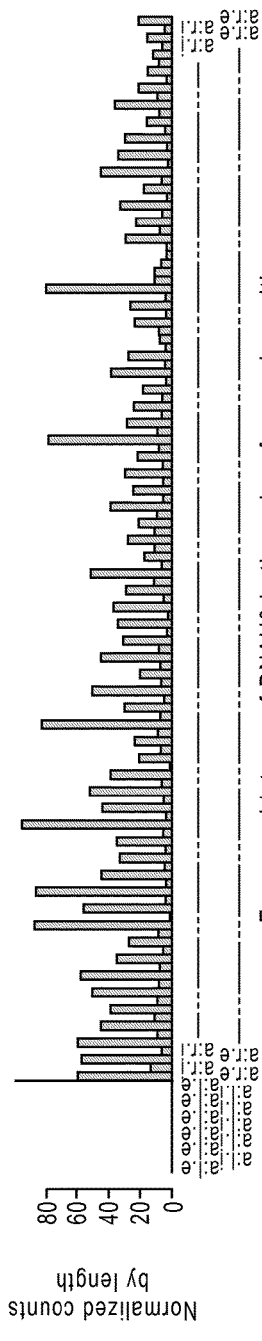
FIGURE 4.56C

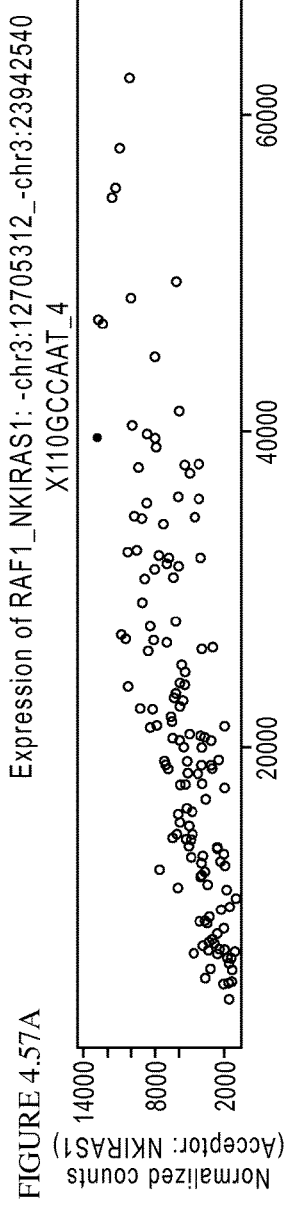
FIGURE 4.57A
FIGURE 4.57B
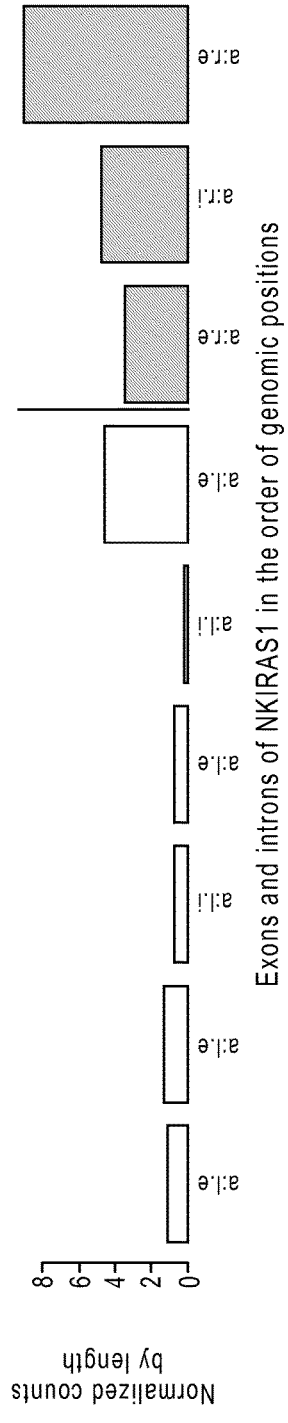
FIGURE 4.57C

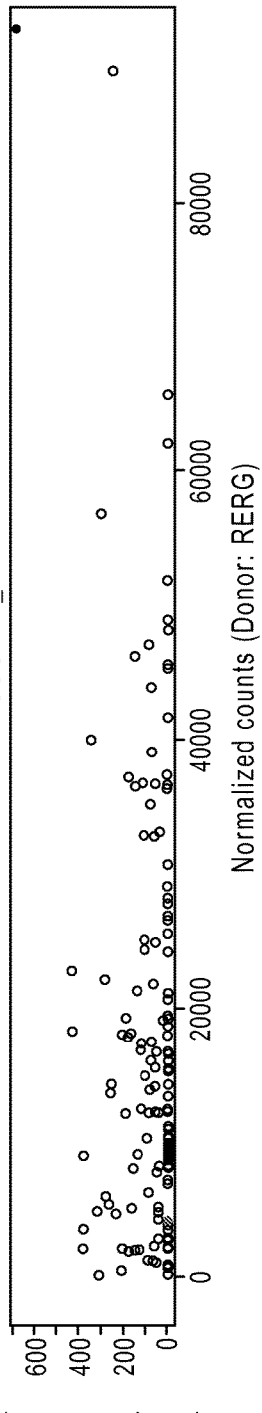
FIGURE 4.58A
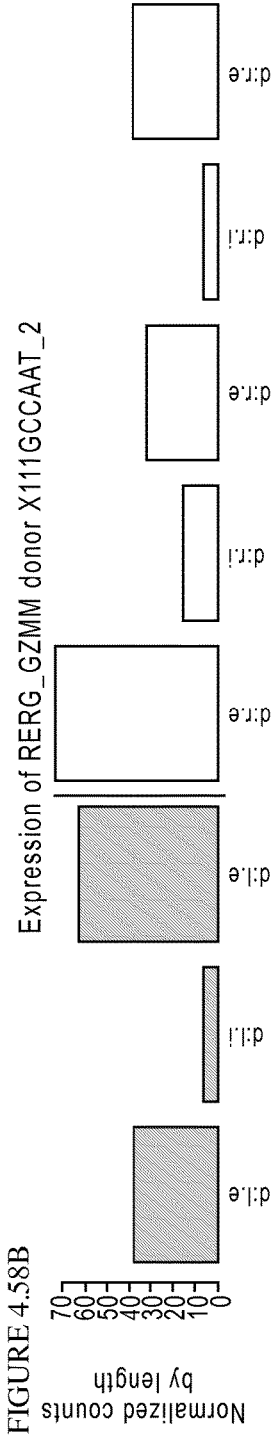
FIGURE 4.58B
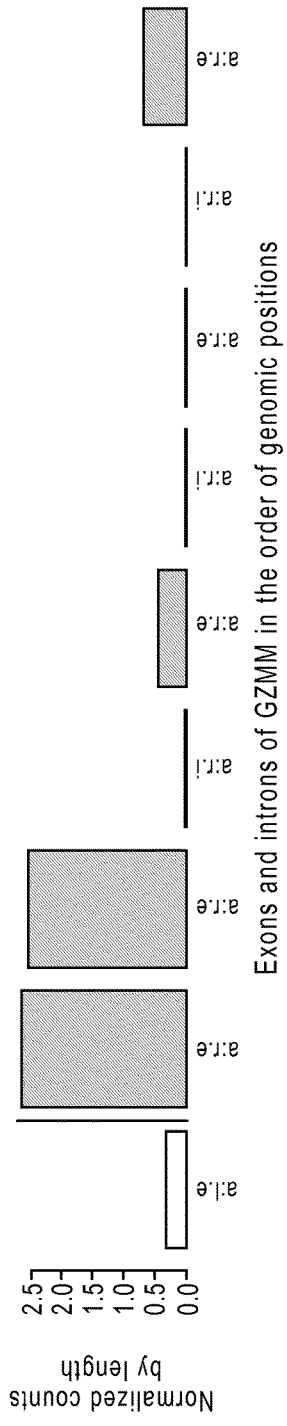
FIGURE 4.58C

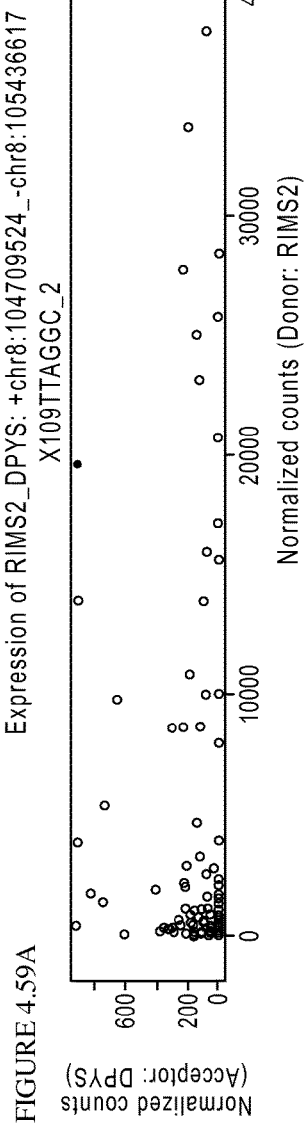
FIGURE 4.59A
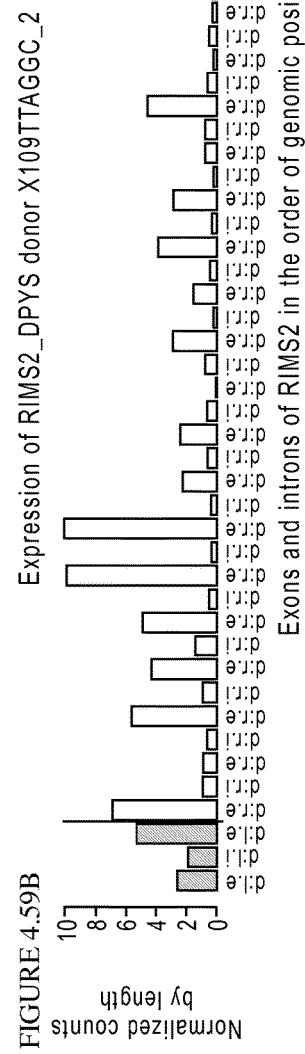
FIGURE 4.59B
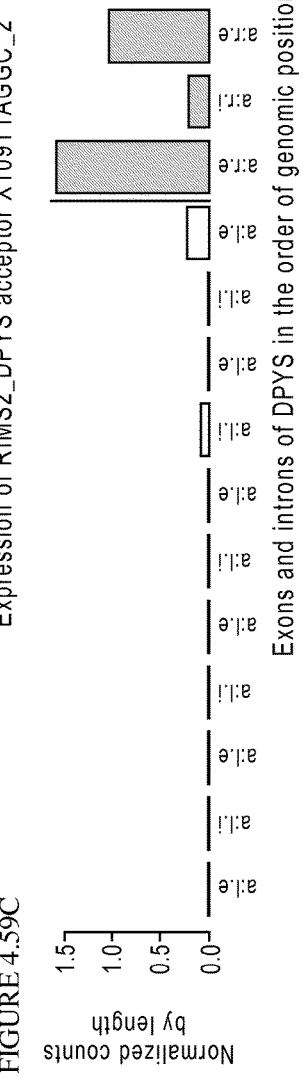
FIGURE 4.59C

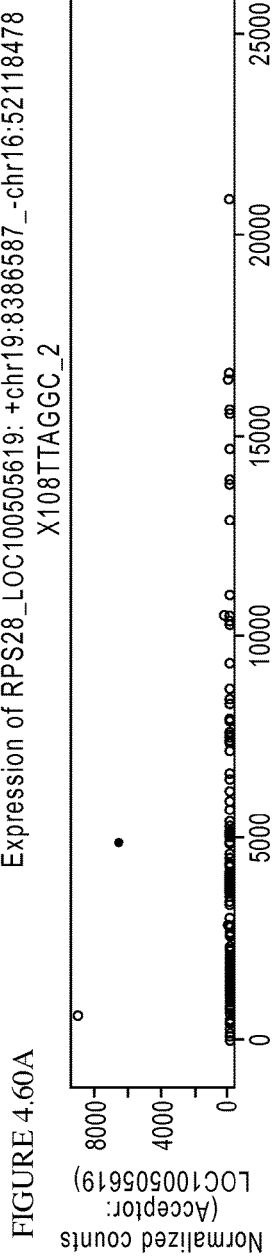
FIGURE 4.60A
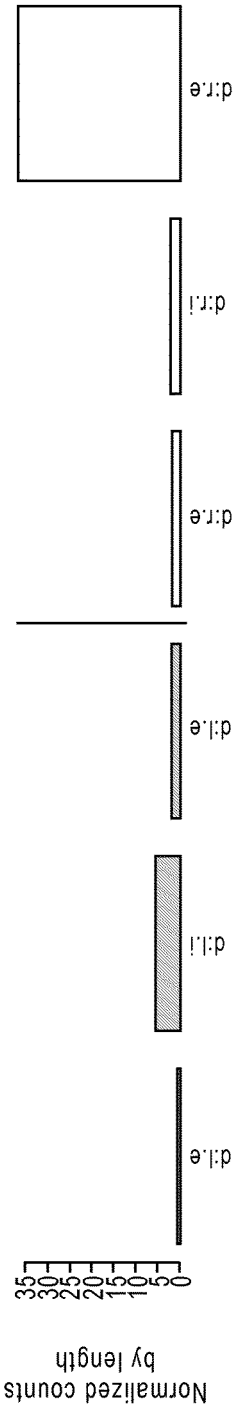
FIGURE 4.60B
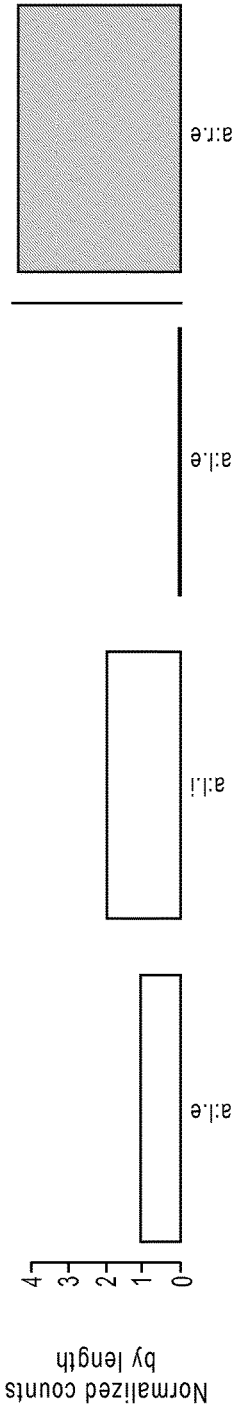
FIGURE 4.60C

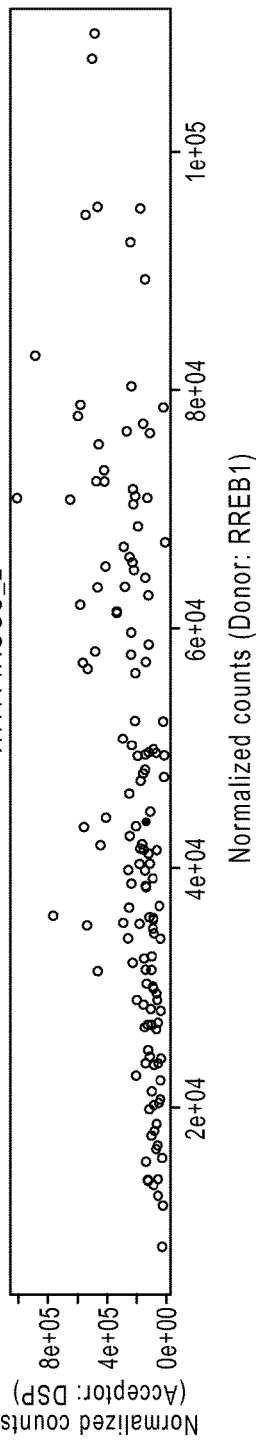
FIGURE 4.61A
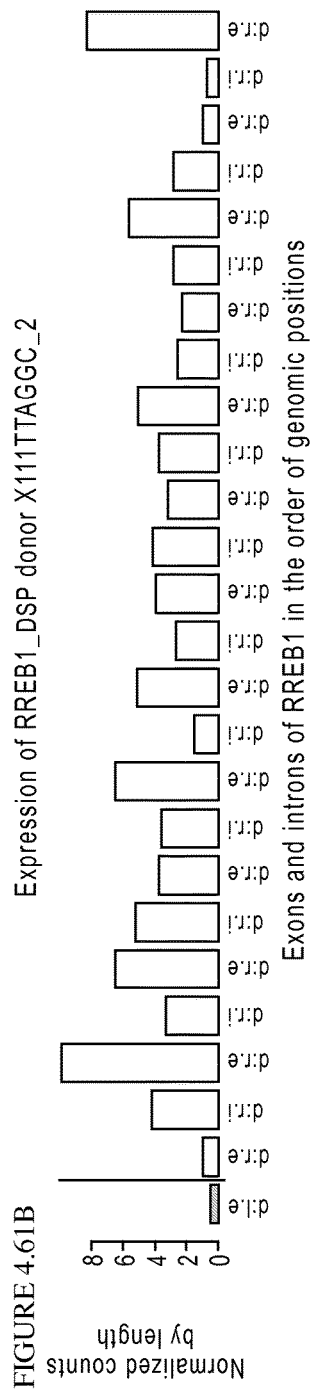
FIGURE 4.61B
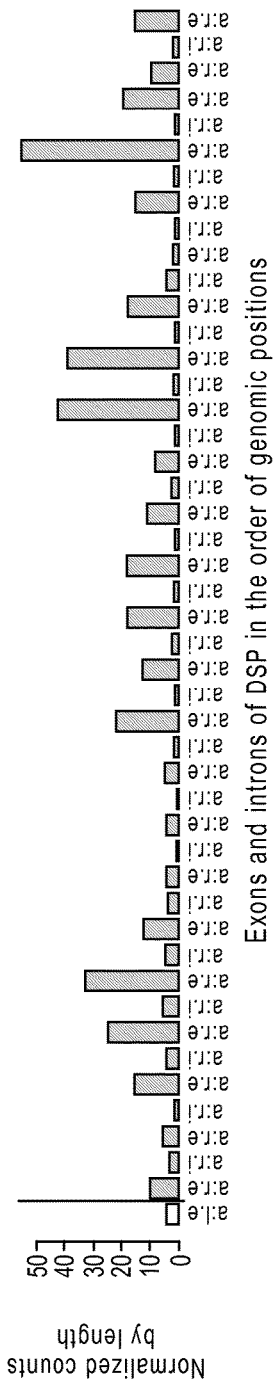
FIGURE 4.61C

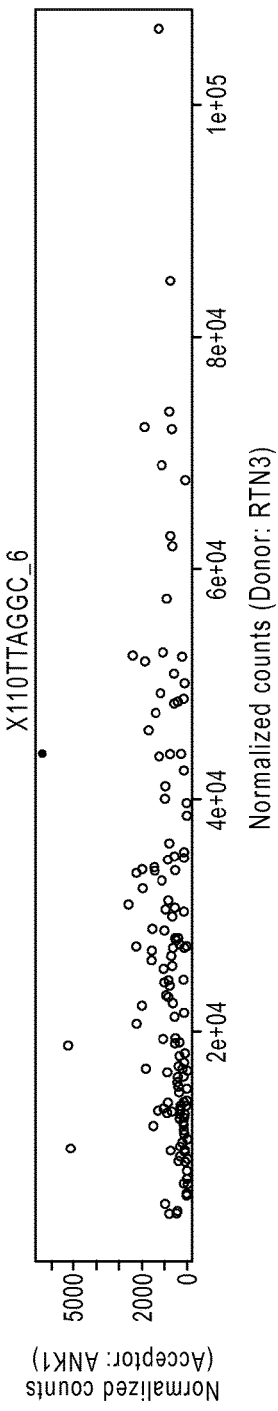
FIGURE 4.62A
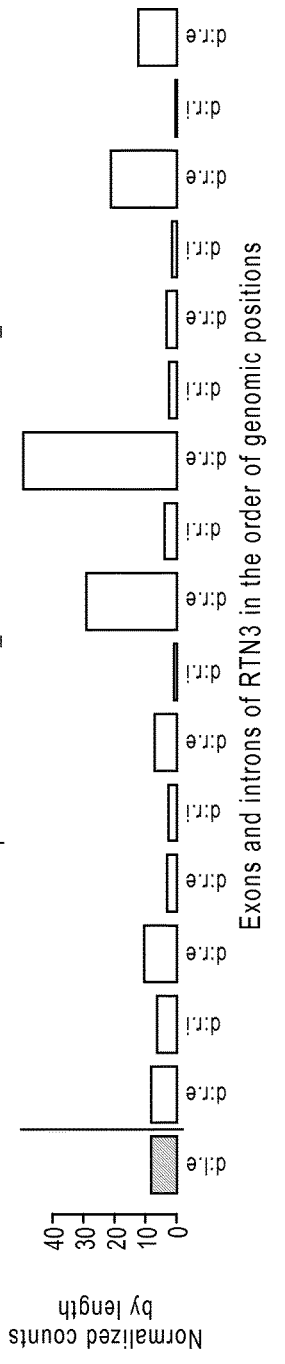
FIGURE 4.62B
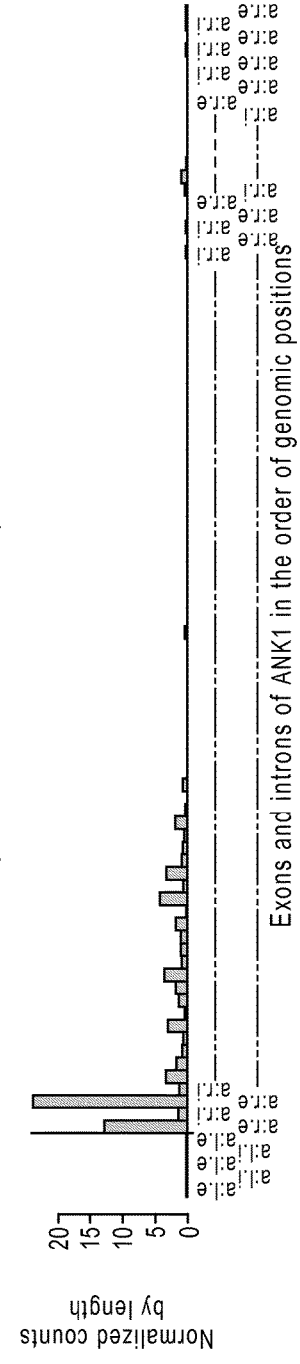
FIGURE 4.62C

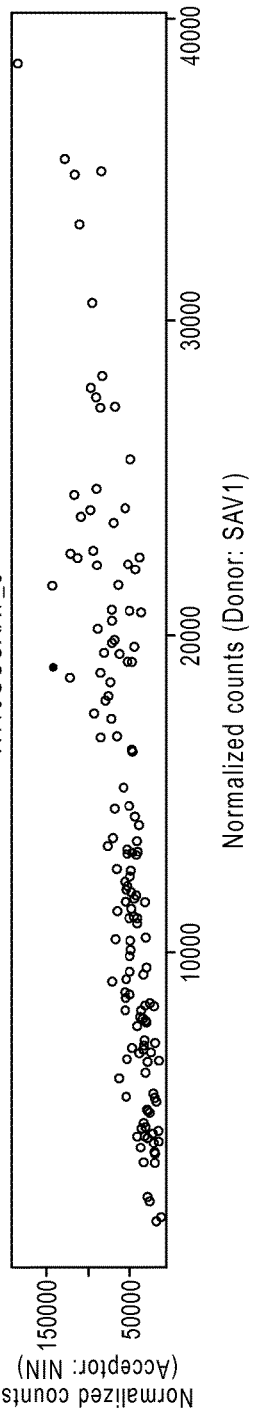
FIGURE 4.63A
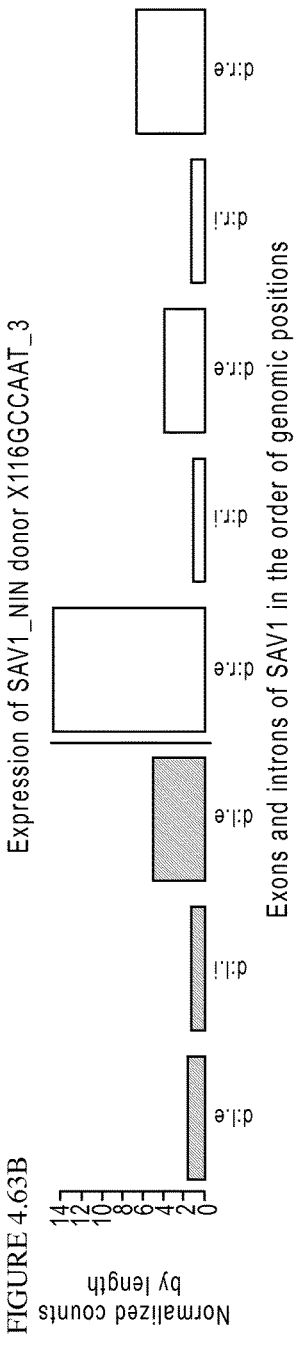
FIGURE 4.63B
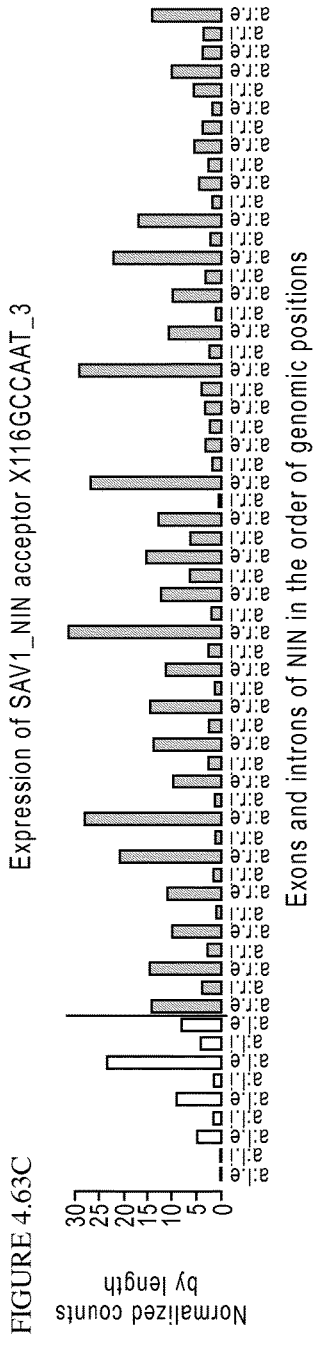
FIGURE 4.63C

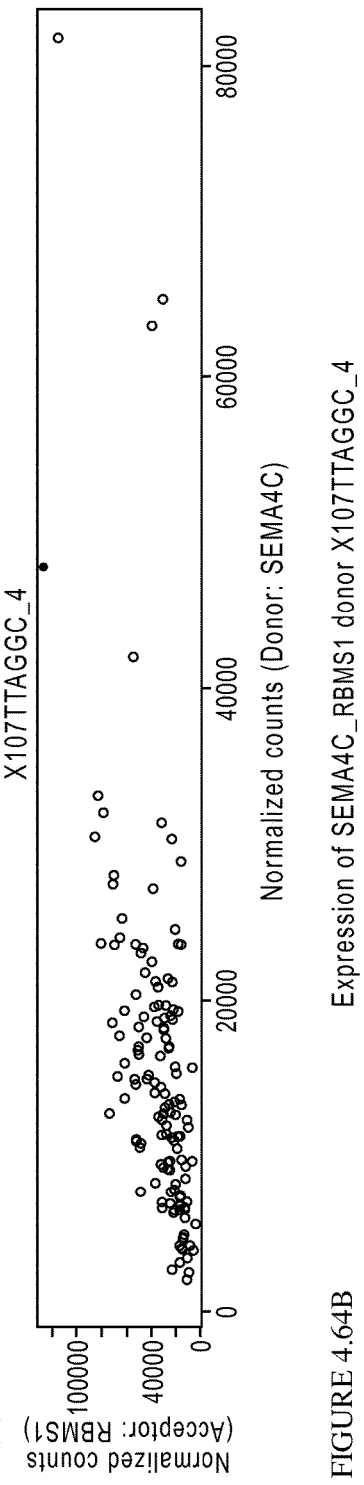
FIGURE 4.64A
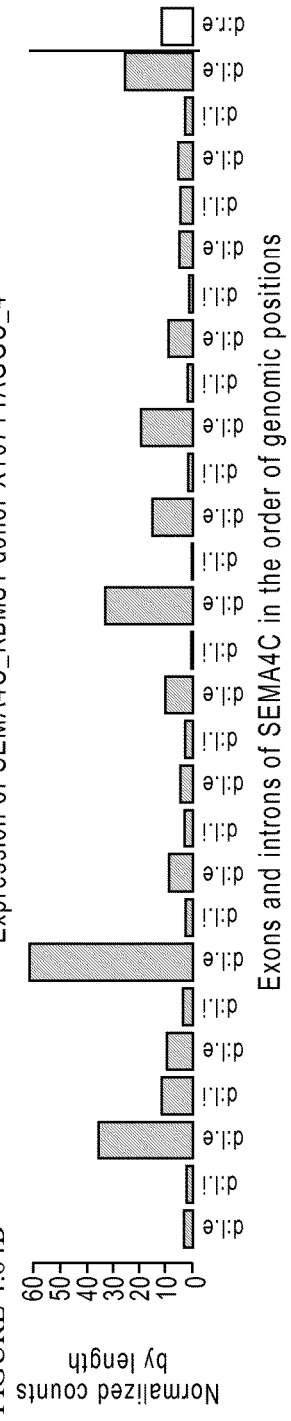
FIGURE 4.64B
FIGURE 4.64C

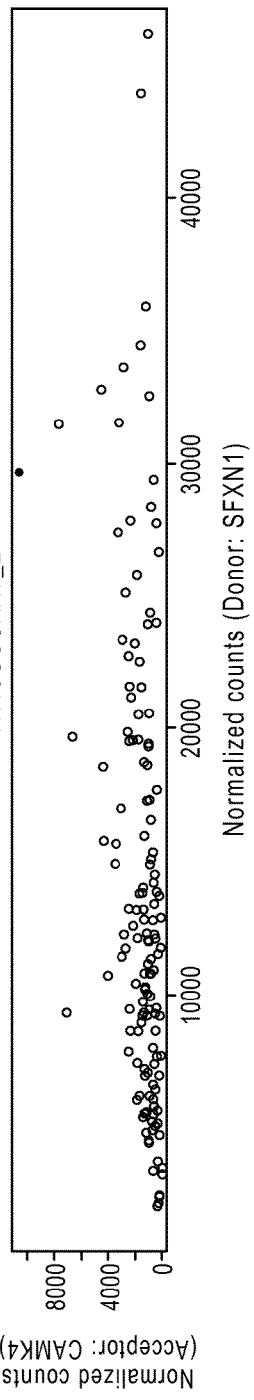
FIGURE 4.65A
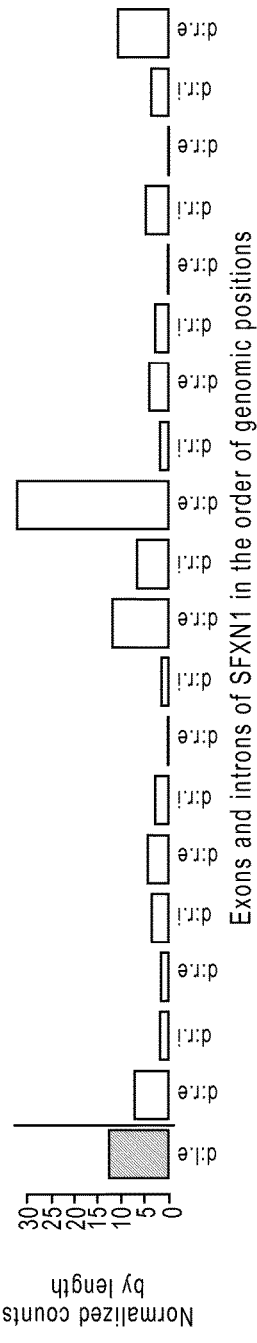
FIGURE 4.65B
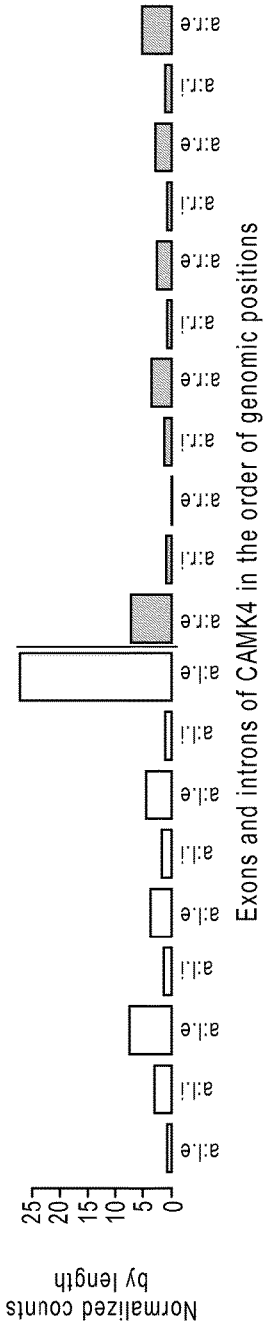
FIGURE 4.65C

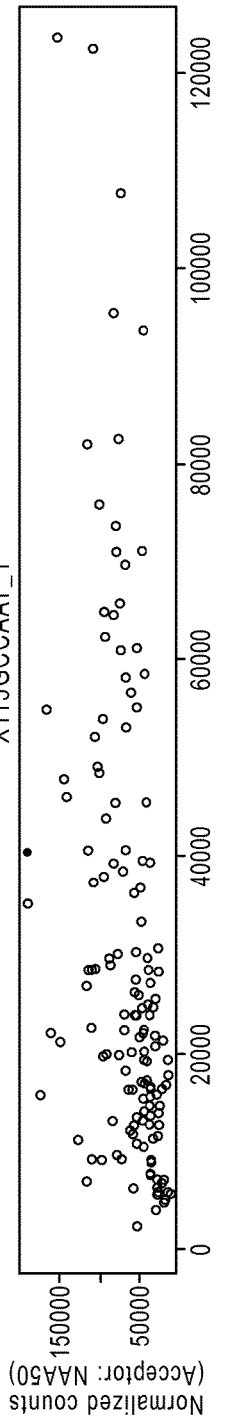
FIGURE 4.66A
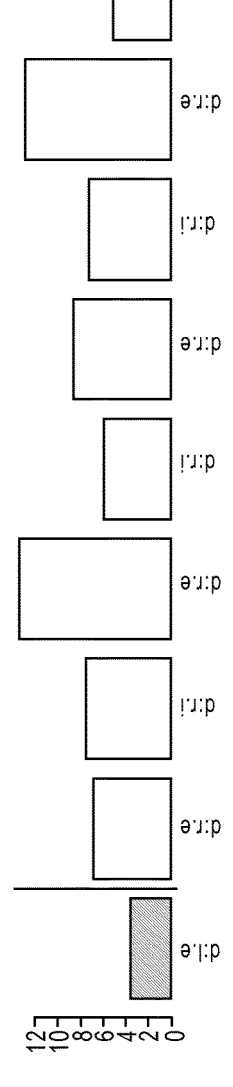
FIGURE 4.66B
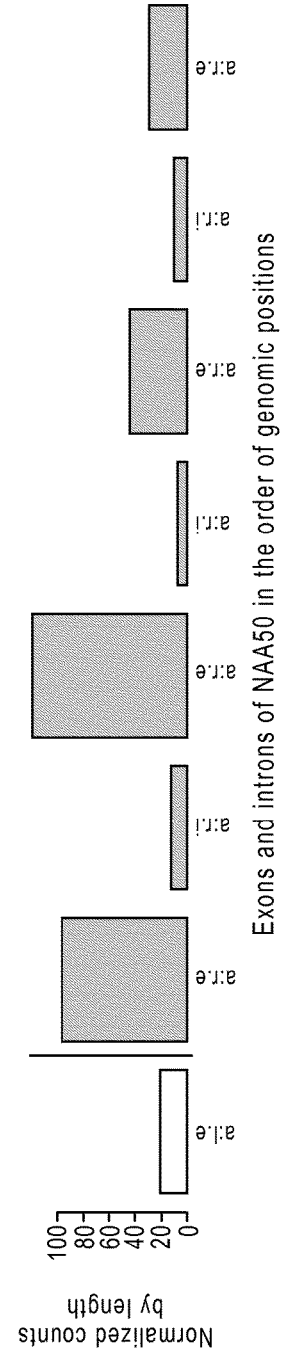
FIGURE 4.66C

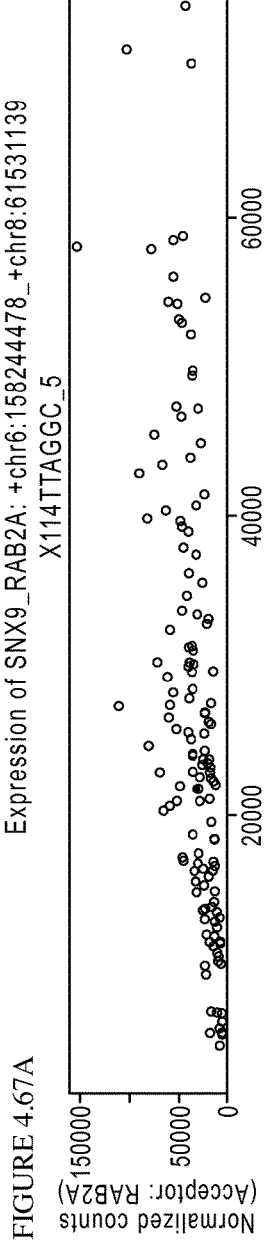
FIGURE 4.67A
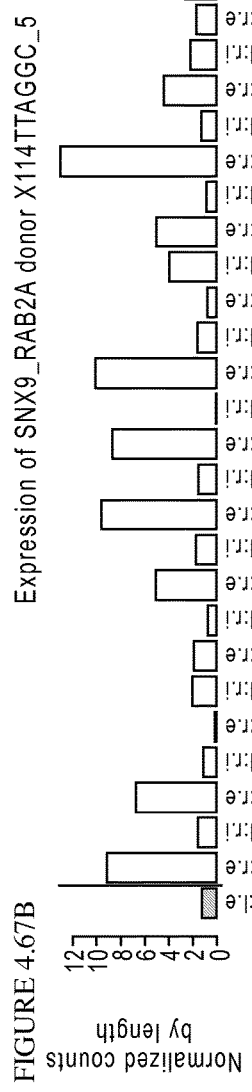
FIGURE 4.67B
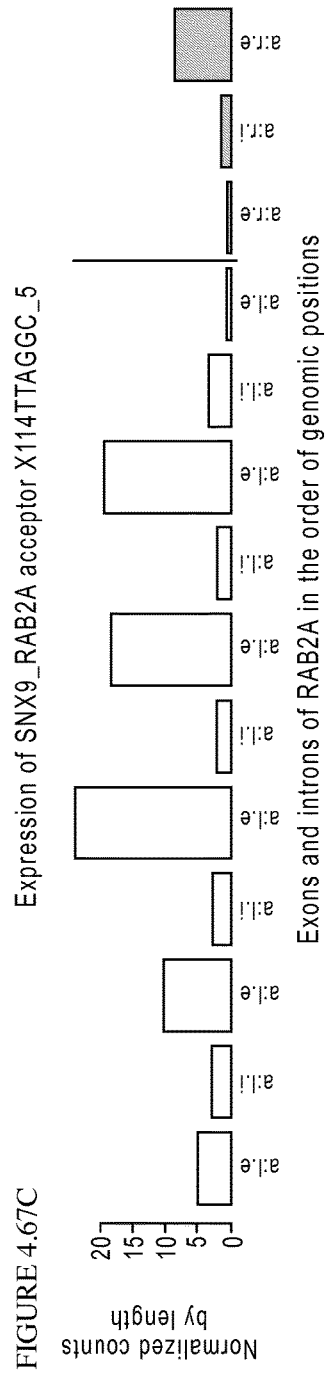
FIGURE 4.67C

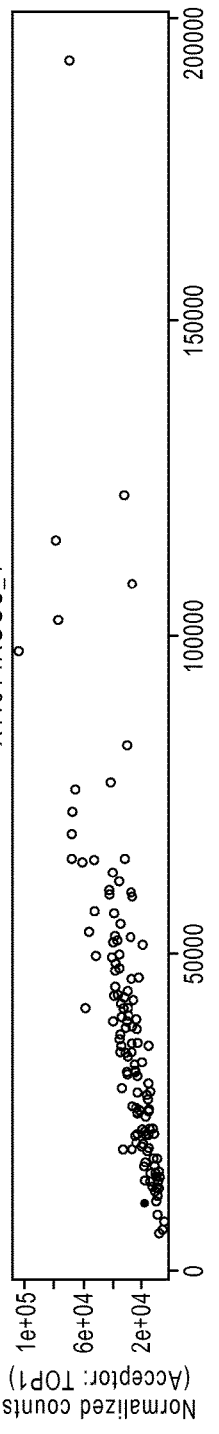
FIGURE 4.68A
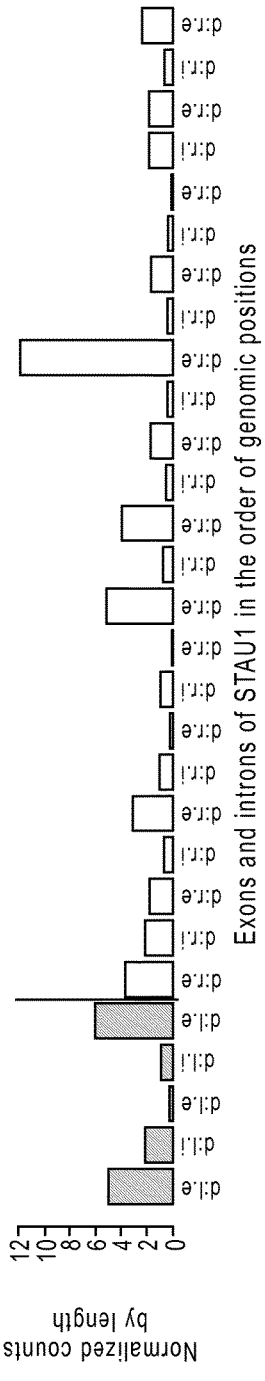
FIGURE 4.68B
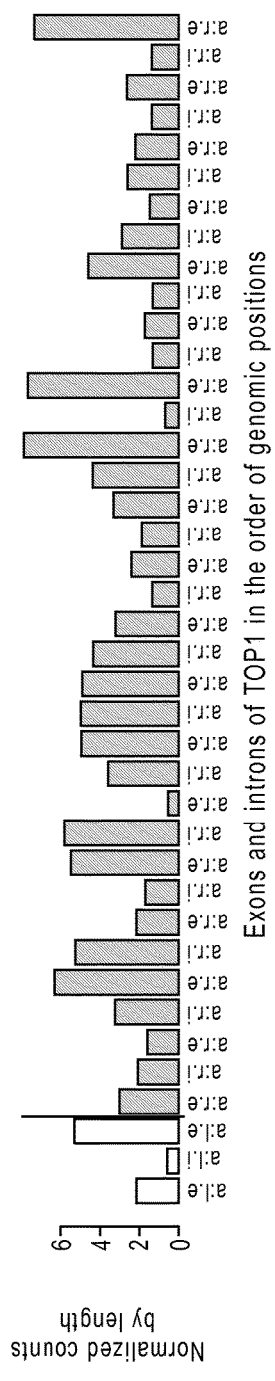
FIGURE 4.68C

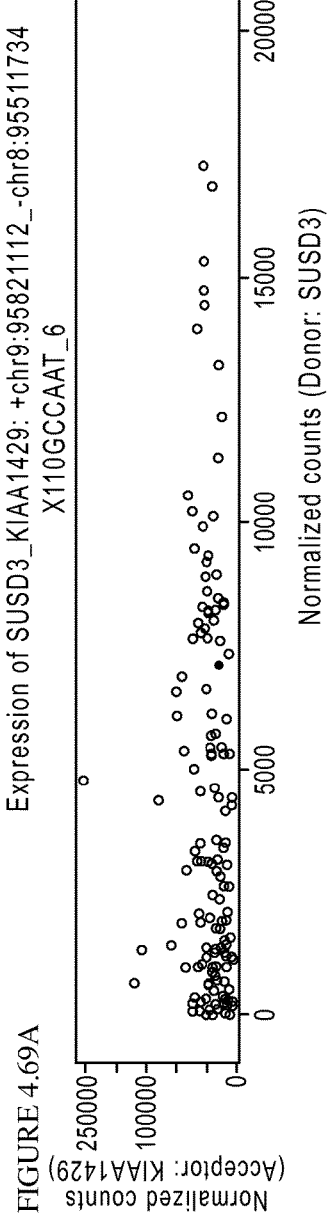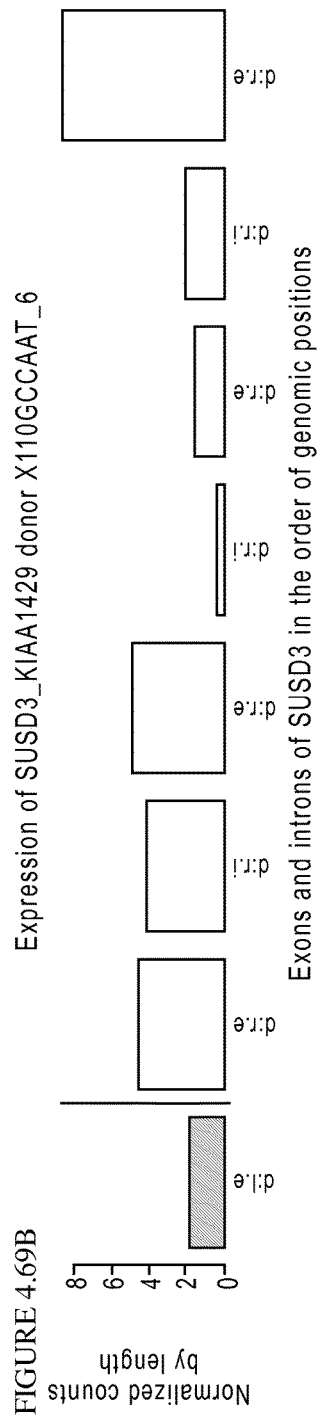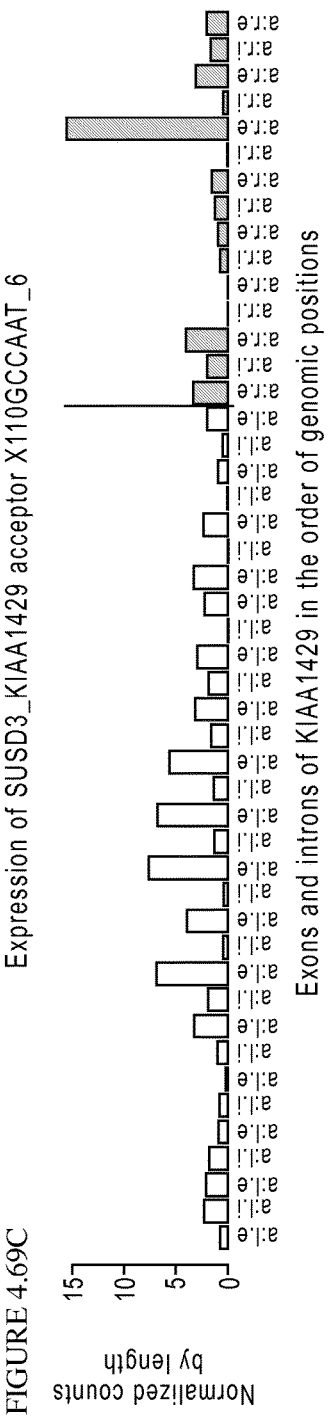

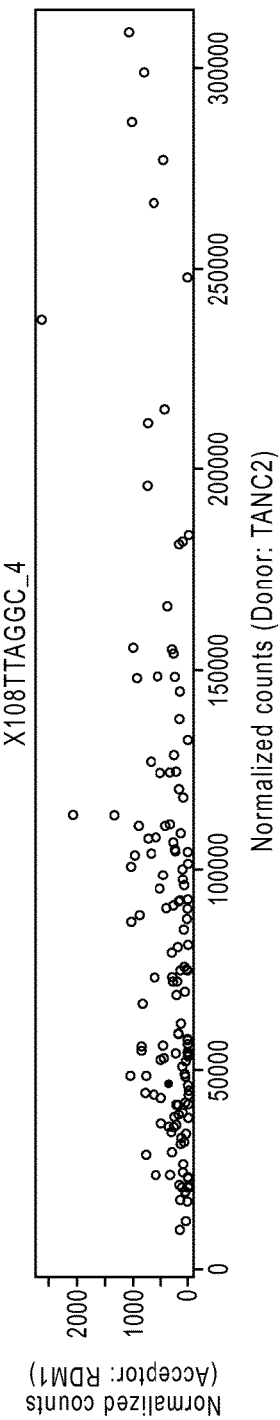
FIGURE 4.70A
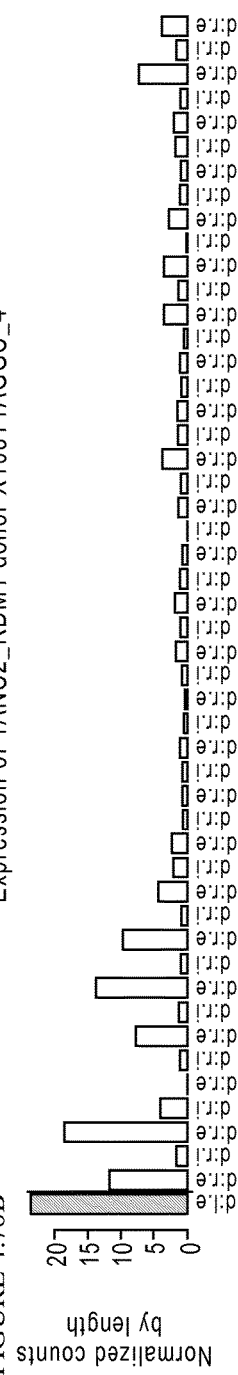
FIGURE 4.70B
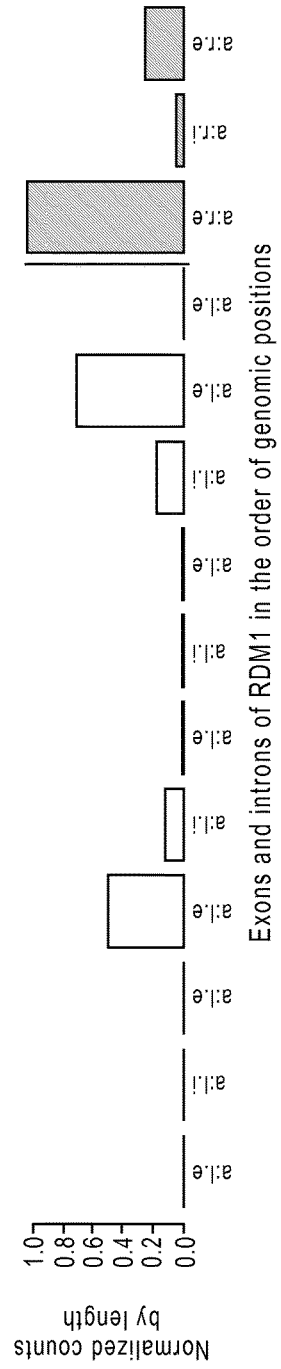
FIGURE 4.70C

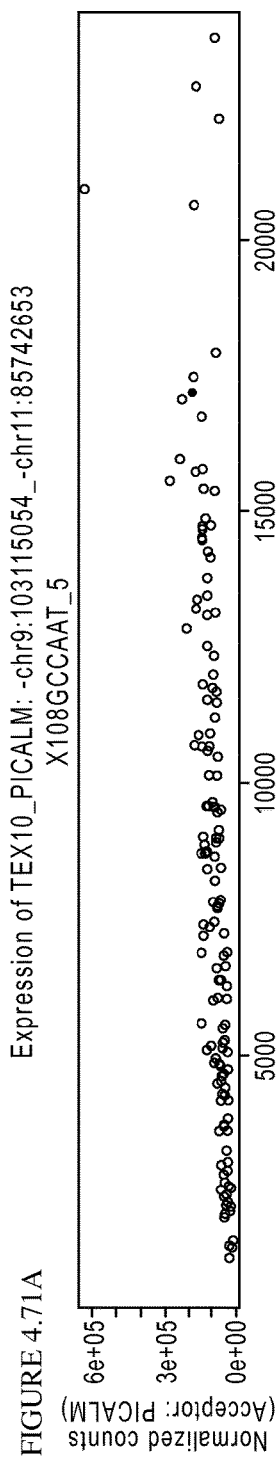
FIGURE 4.71A
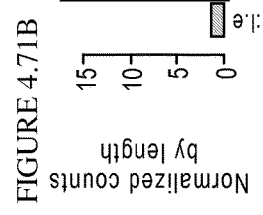
FIGURE 4.71B
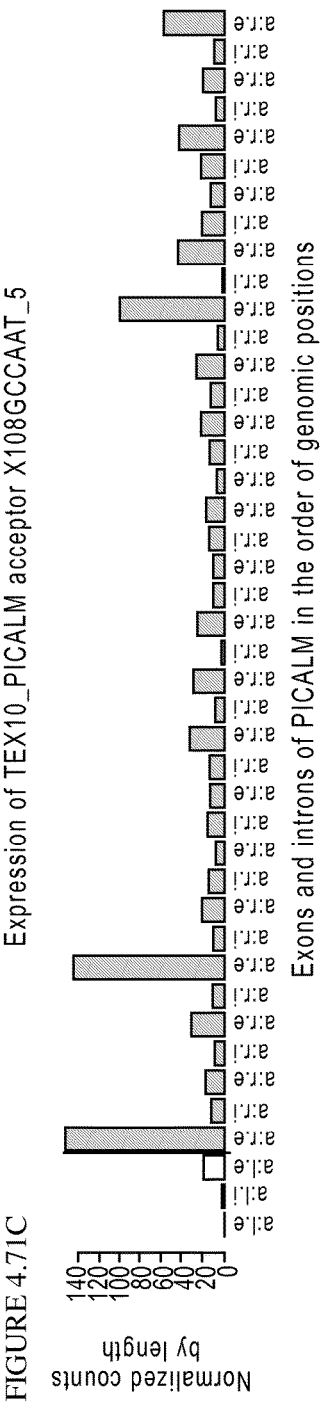
FIGURE 4.71C

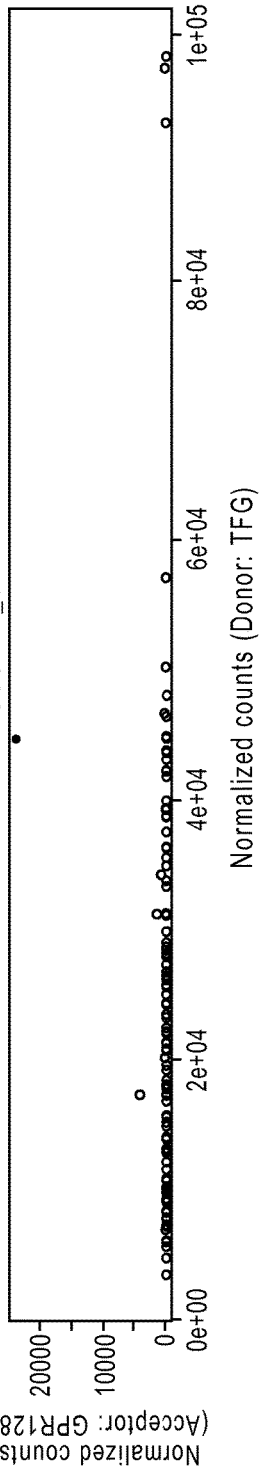
FIGURE 4.72A
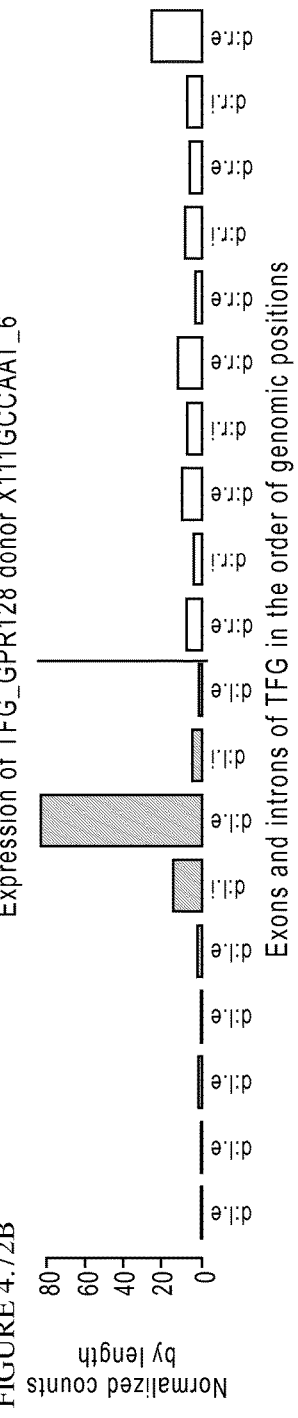
FIGURE 4.72B
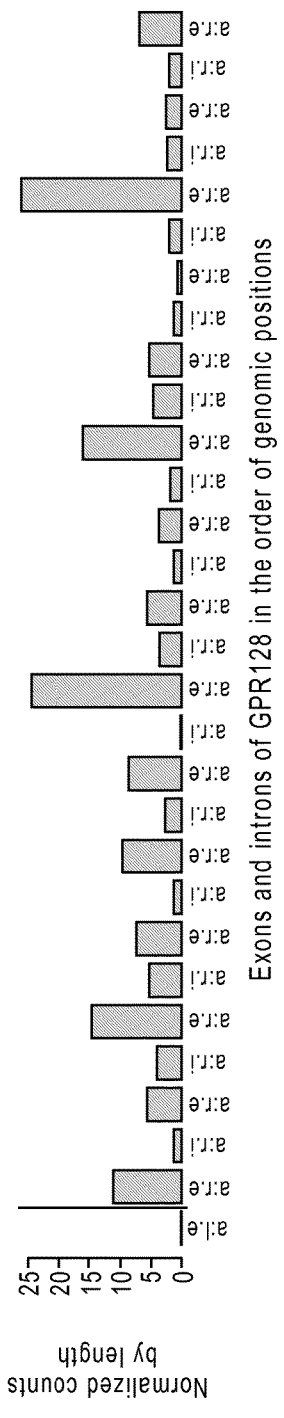
FIGURE 4.72C

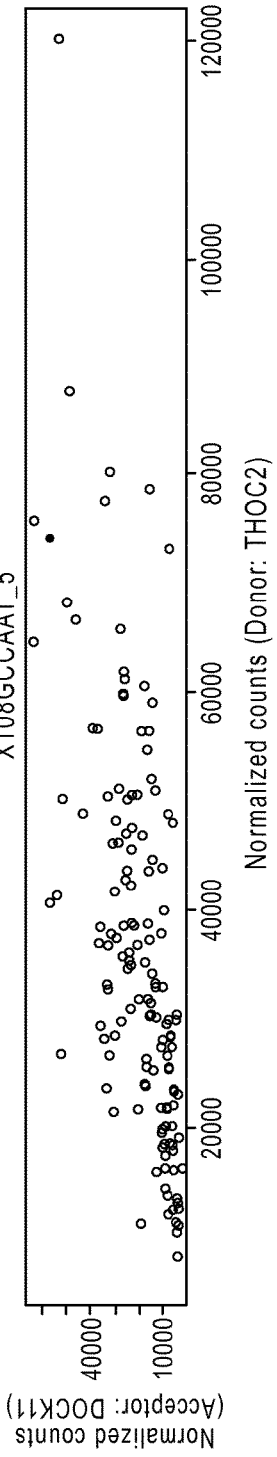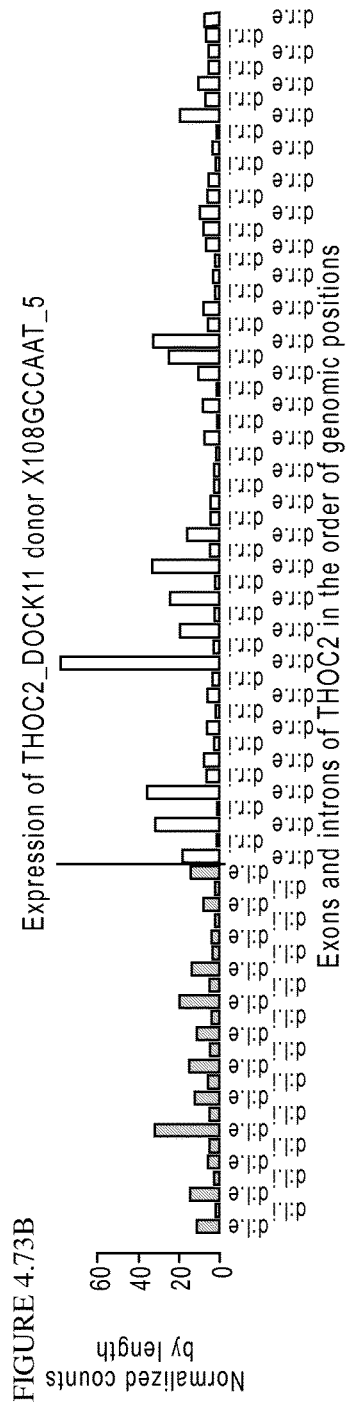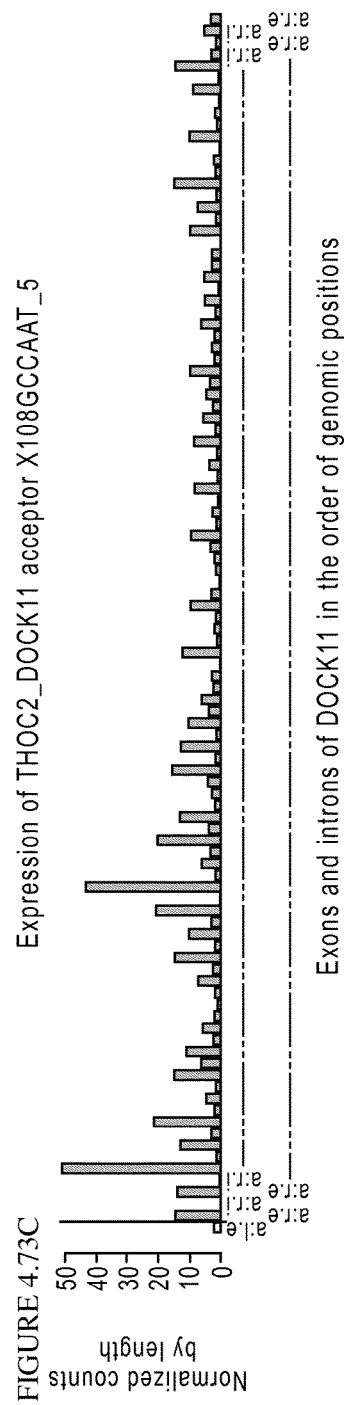
FIGURE 4.73A  FIGURE 4.73B  FIGURE 4.73C

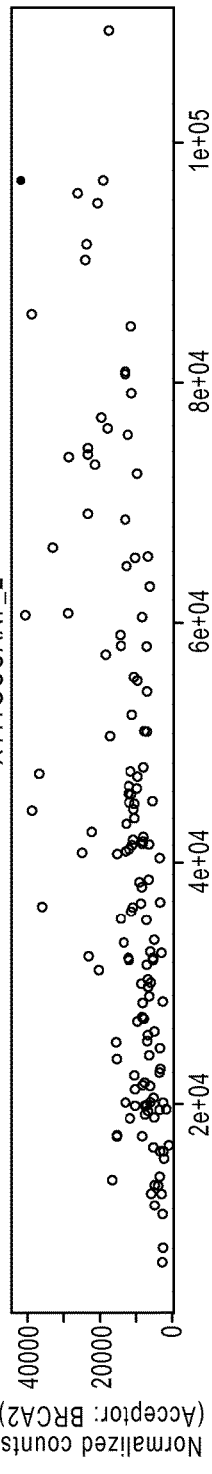
FIGURE 4.74A
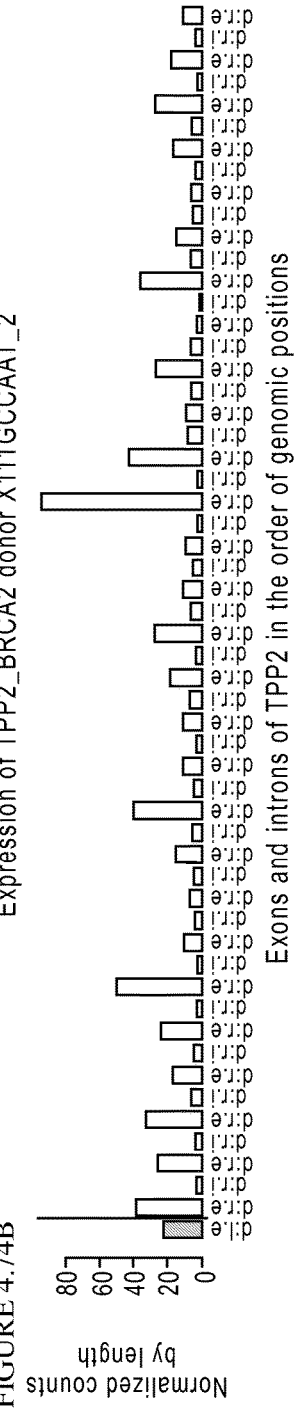
FIGURE 4.74B
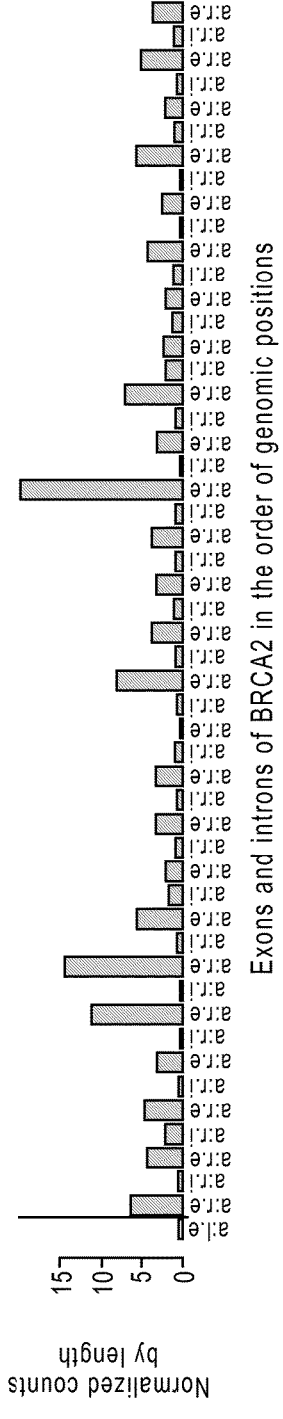
FIGURE 4.74C

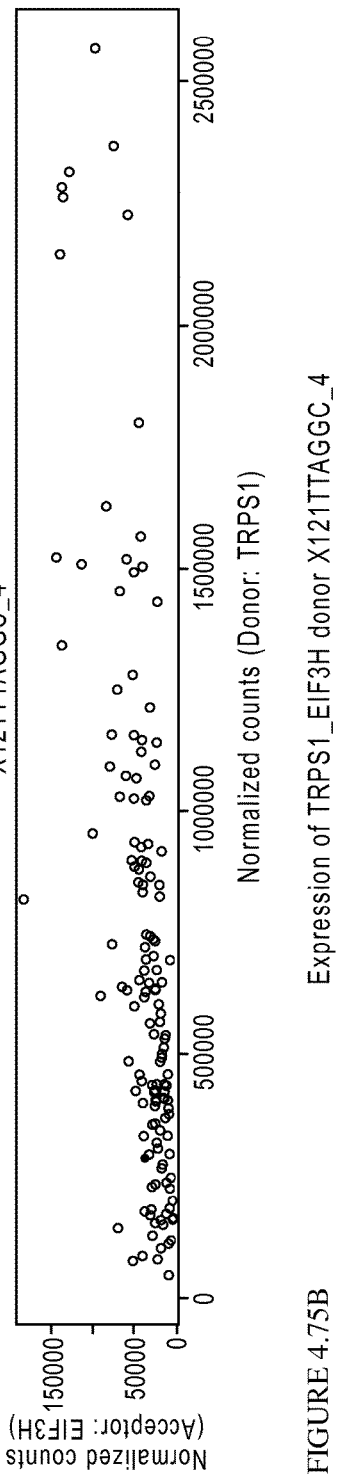
FIGURE 4.75A
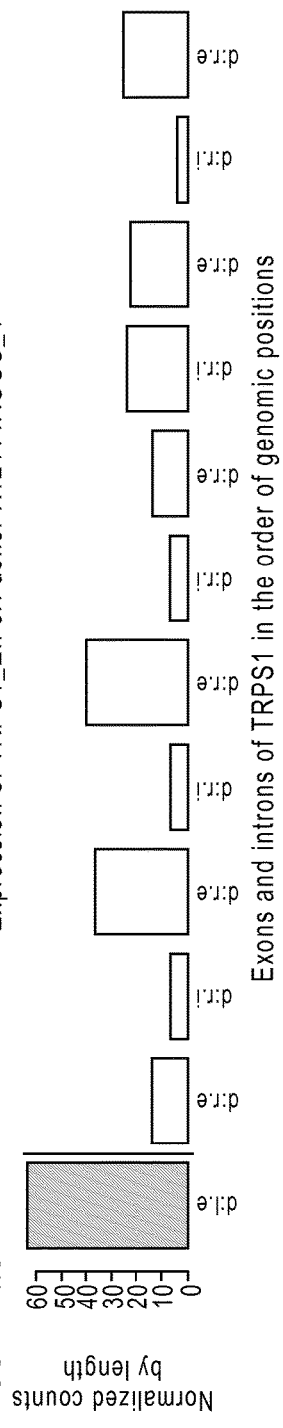
FIGURE 4.75B
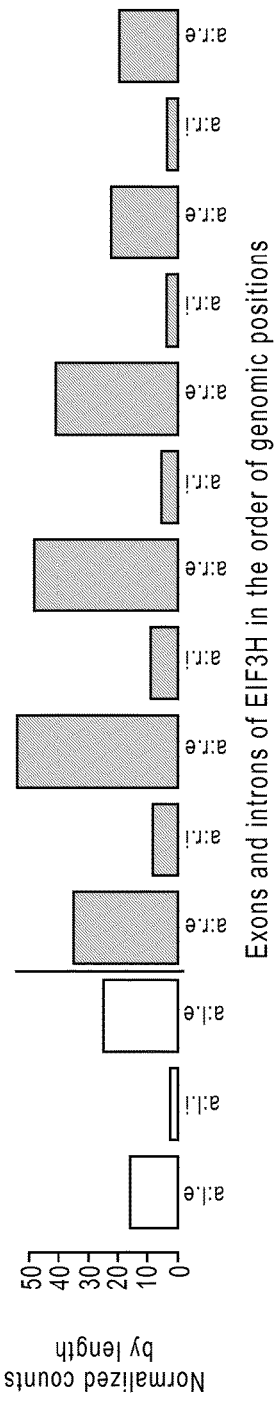
FIGURE 4.75C

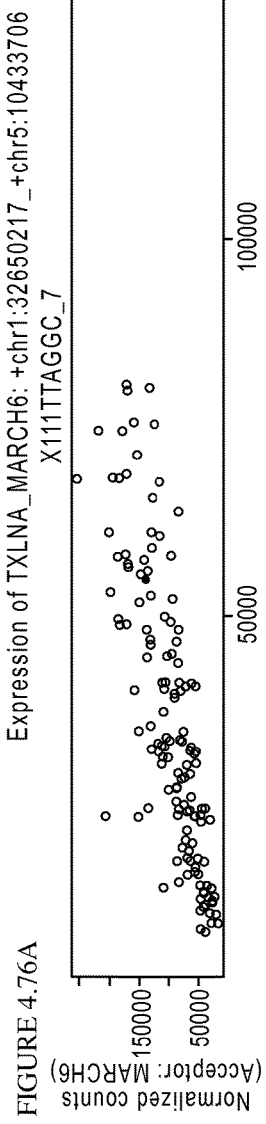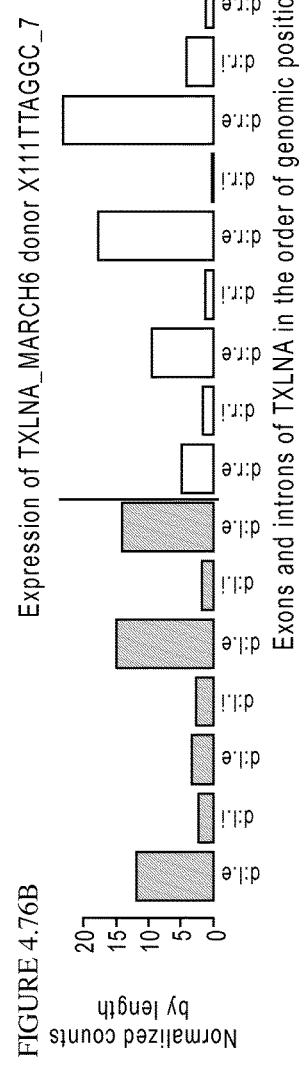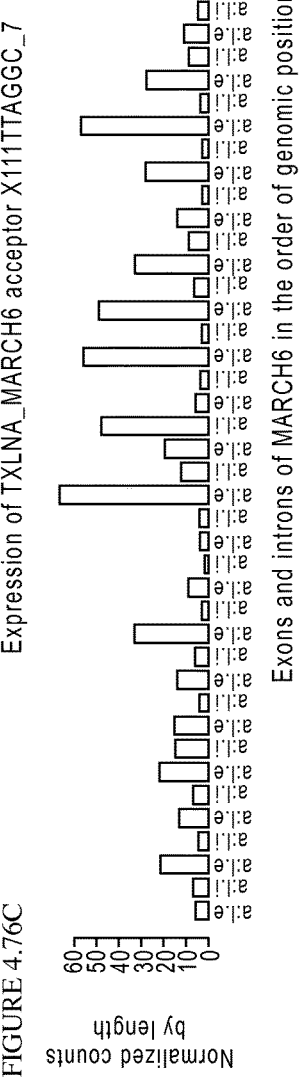
FIGURE 4.76A  FIGURE 4.76B  FIGURE 4.76C

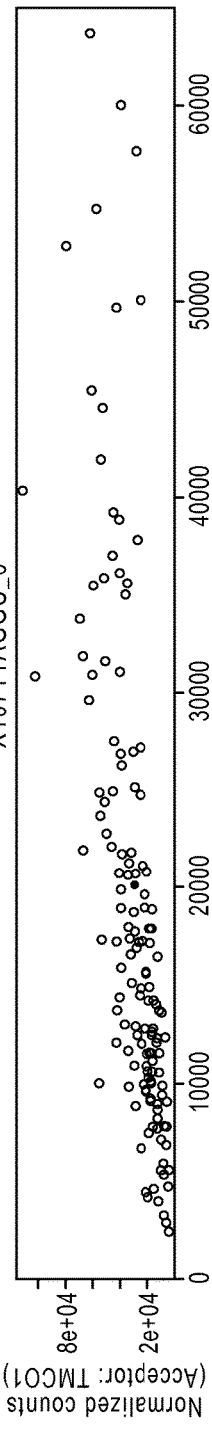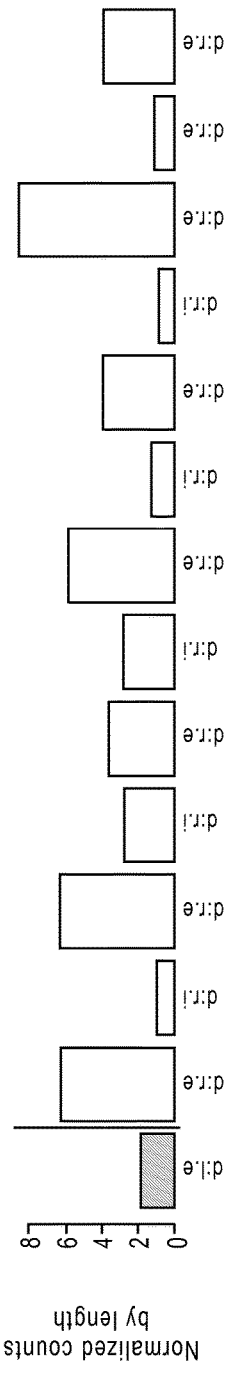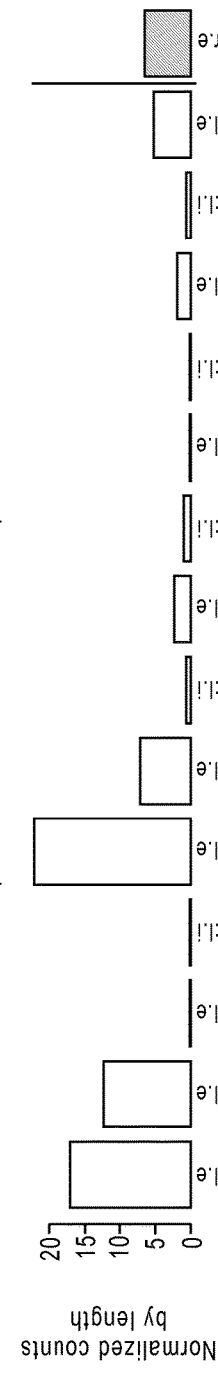
FIGURE 4.77A
FIGURE 4.77B
FIGURE 4.77C

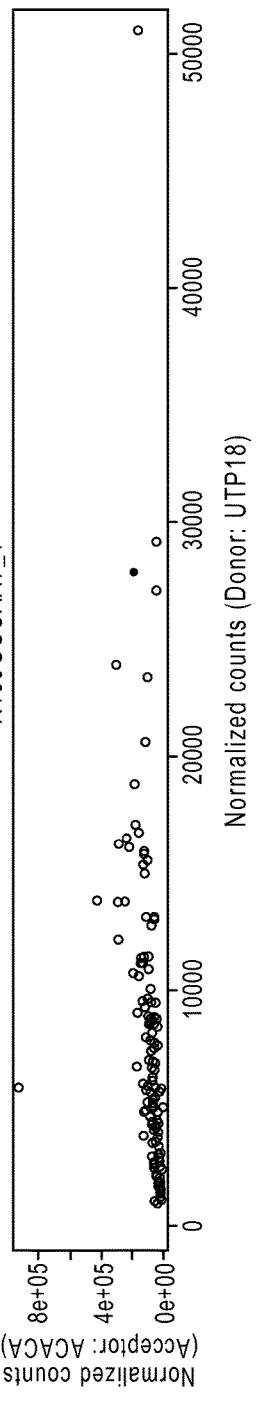
FIGURE 4.78A
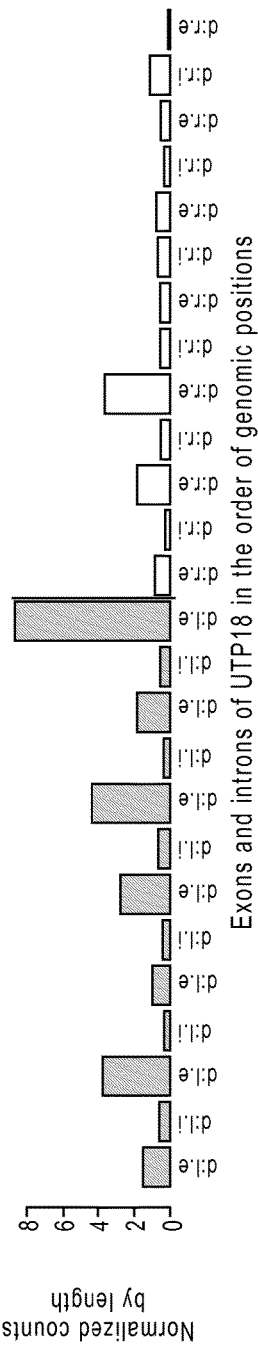
FIGURE 4.78B
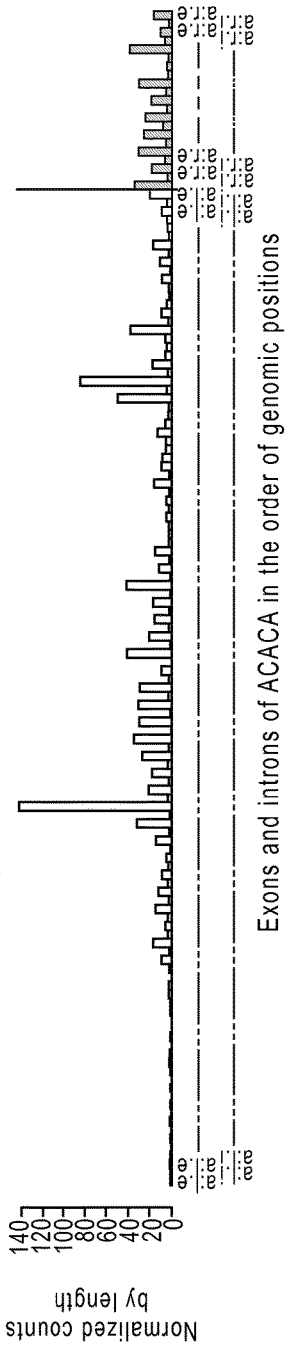
FIGURE 4.78C

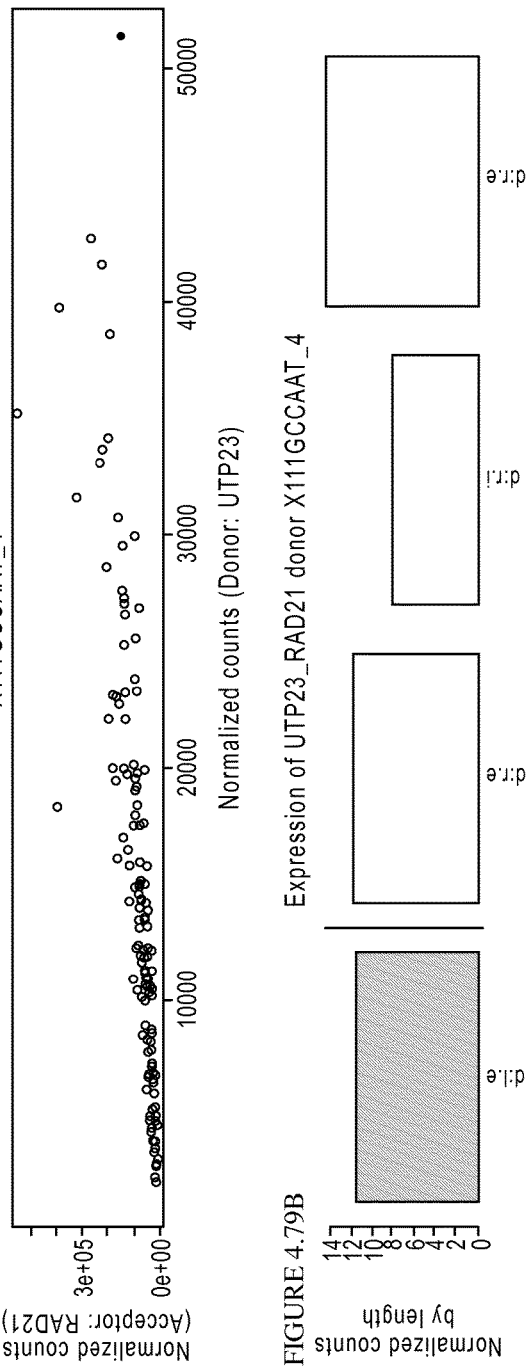
FIGURE 4.79A
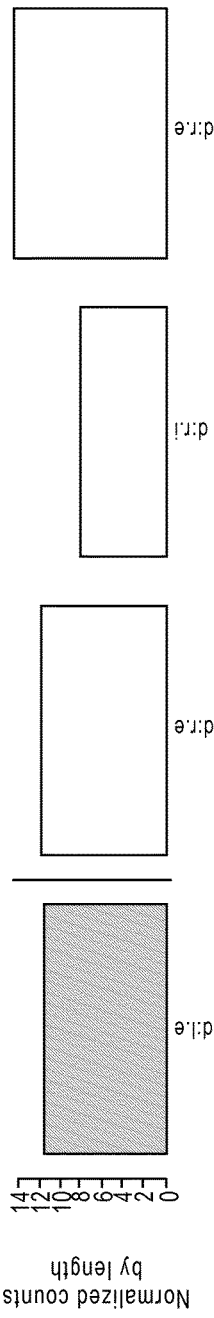
FIGURE 4.79B
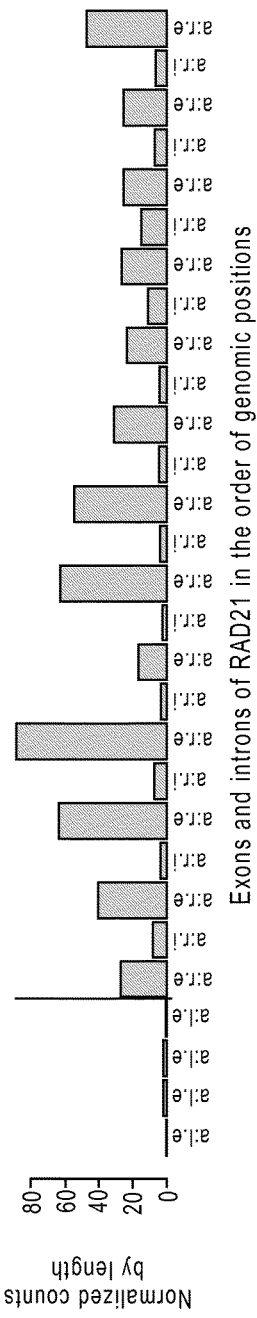
FIGURE 4.79C

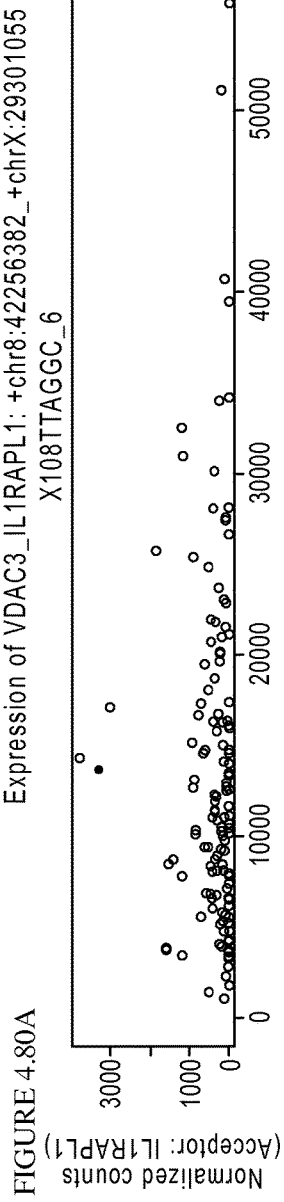
FIGURE 4.80A
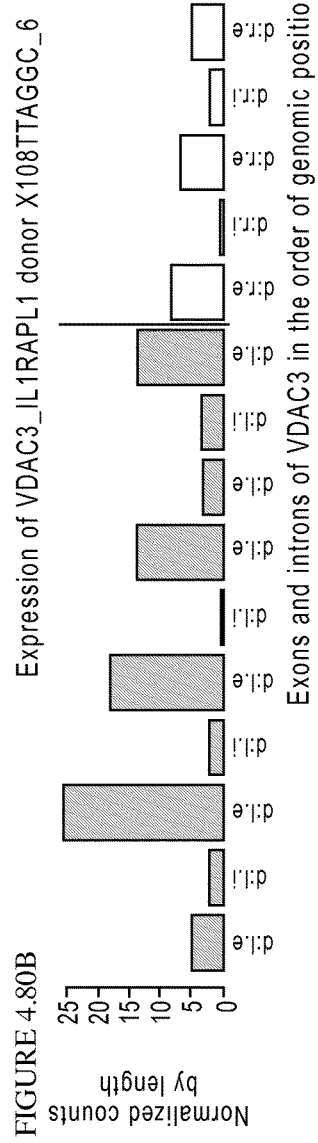
FIGURE 4.80B
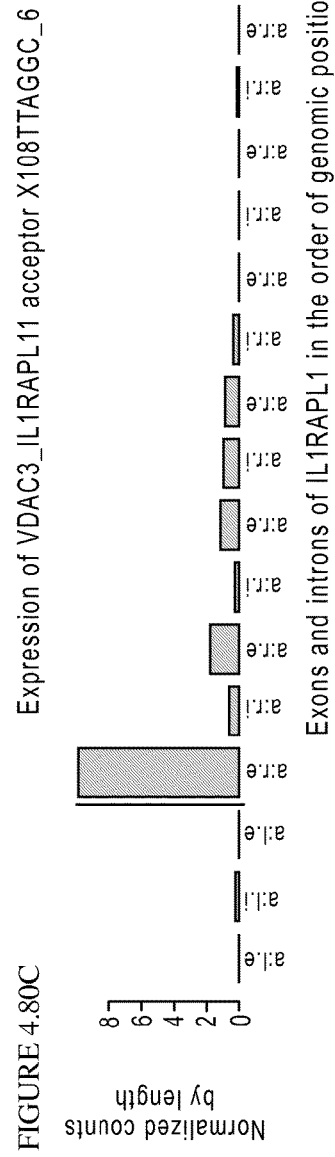
FIGURE 4.80C

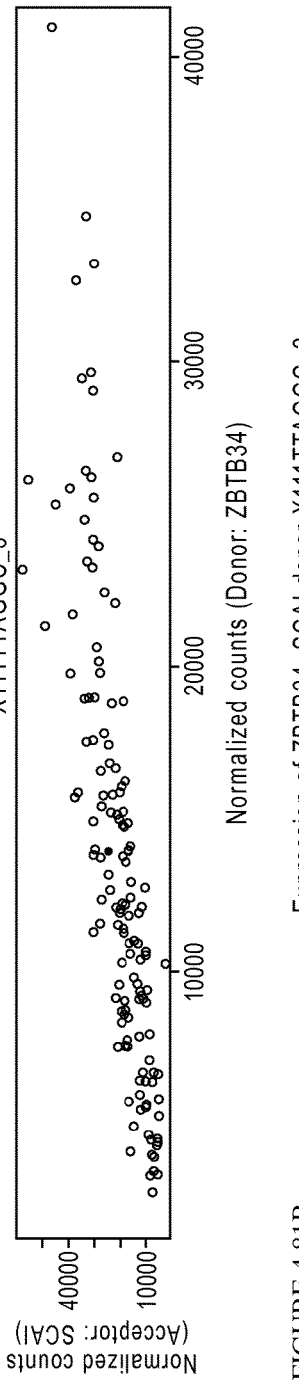
FIGURE 4.81A
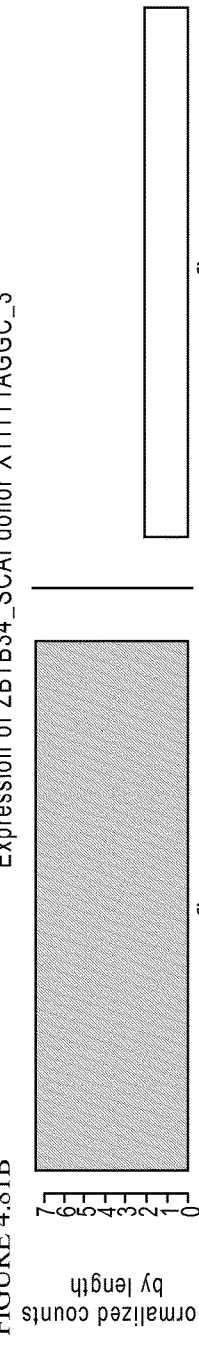
FIGURE 4.81B
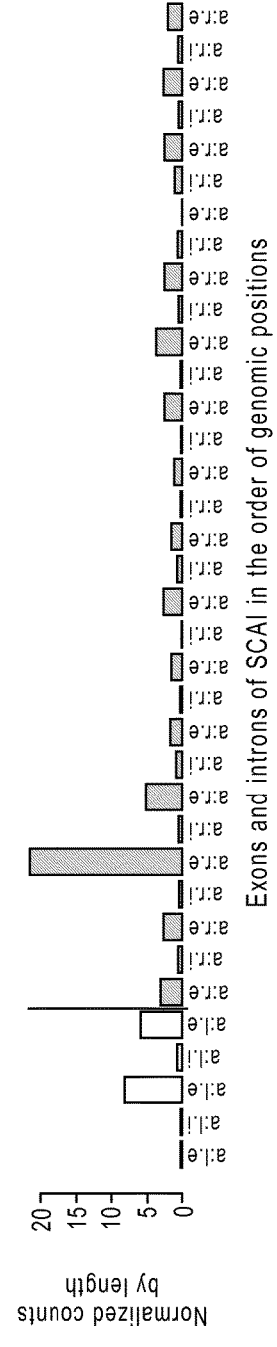
FIGURE 4.81C

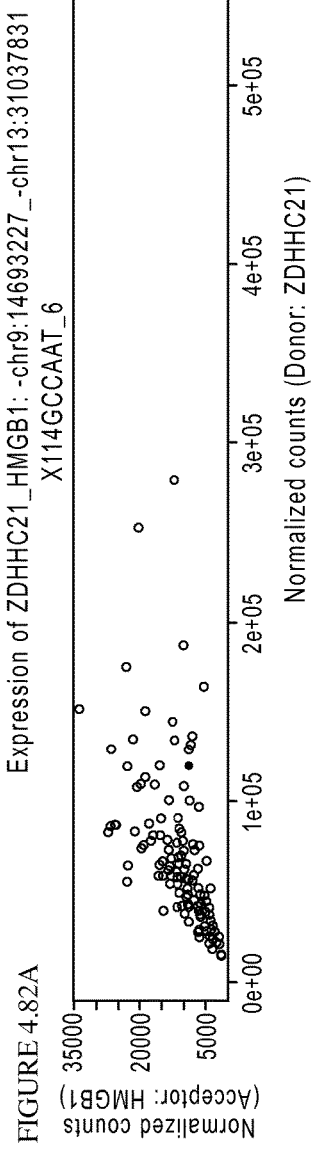
FIGURE 4.82A
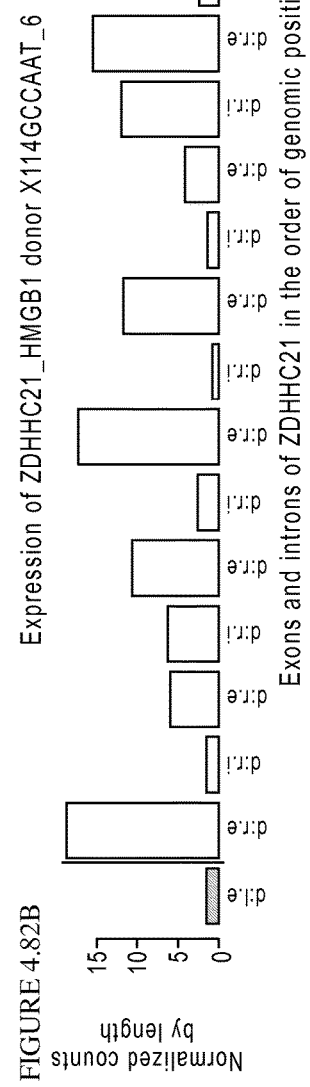
FIGURE 4.82B
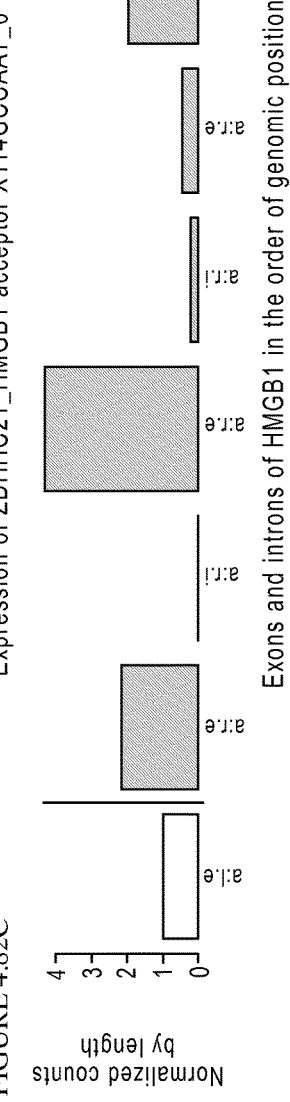
FIGURE 4.82C

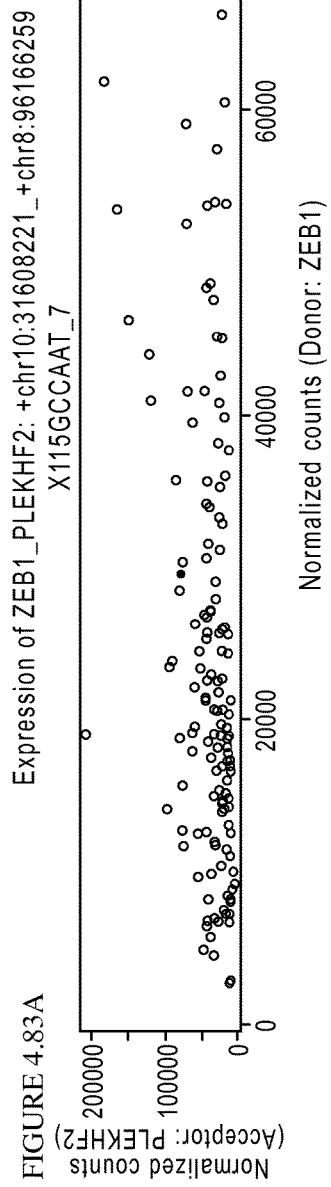
FIGURE 4.83A
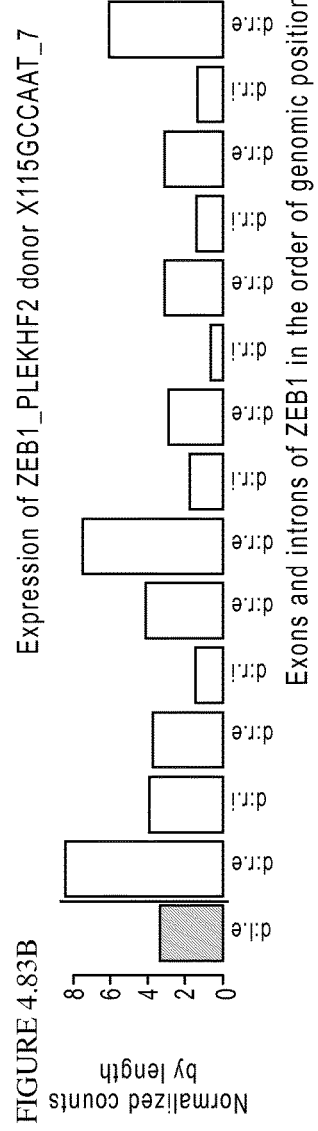
FIGURE 4.83B
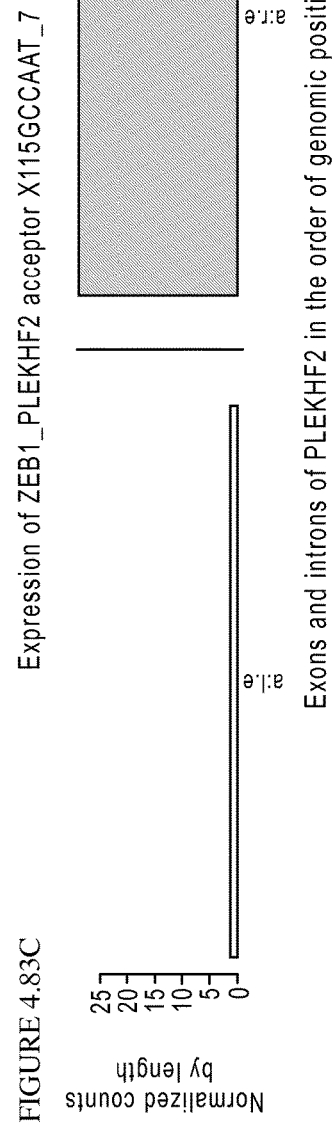
FIGURE 4.83C

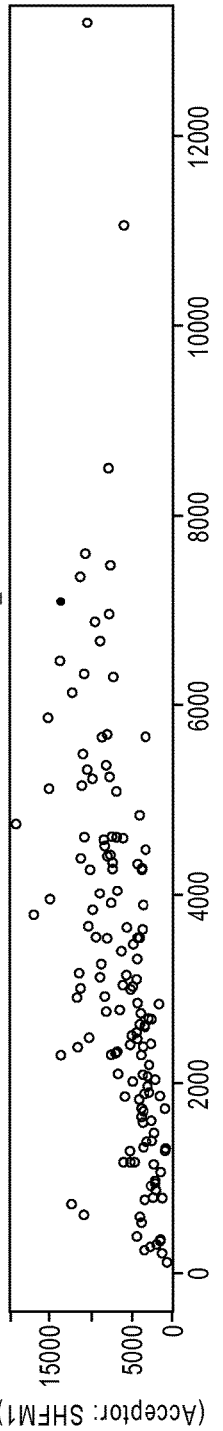
FIGURE 4.84A
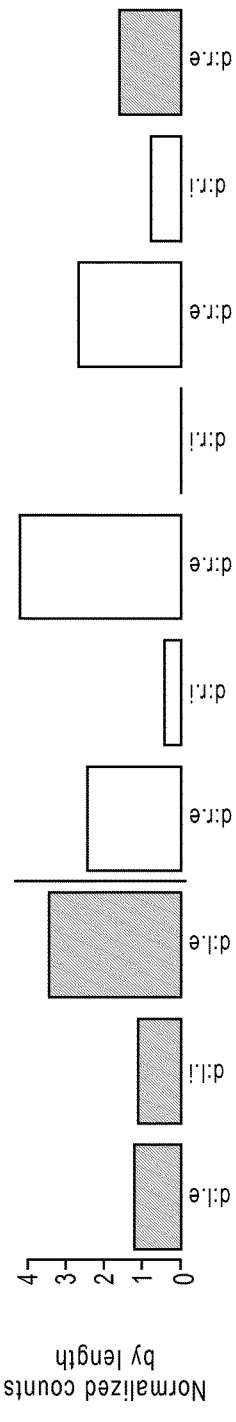
FIGURE 4.84B
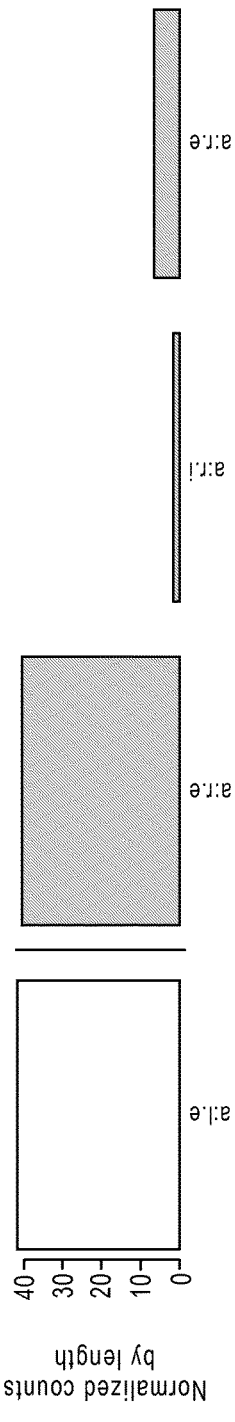
FIGURE 4.84C

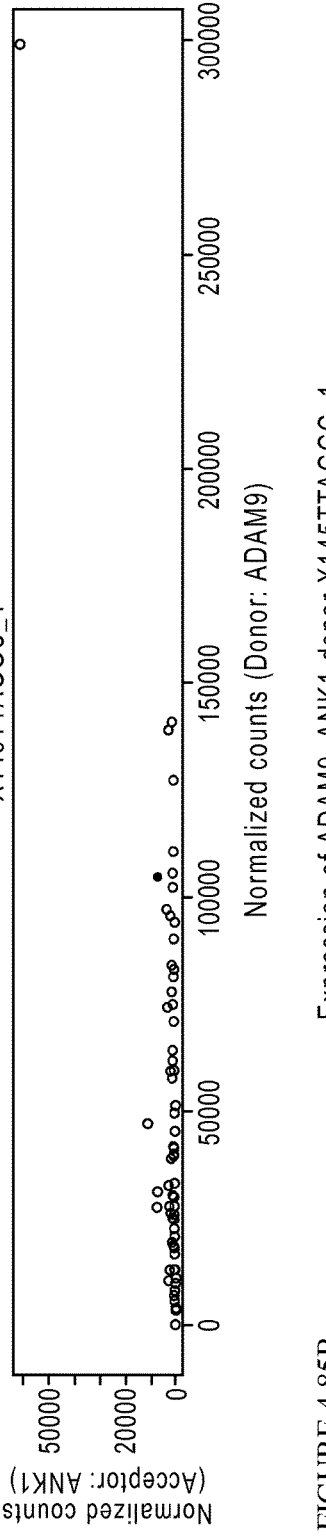
FIGURE 4.85A
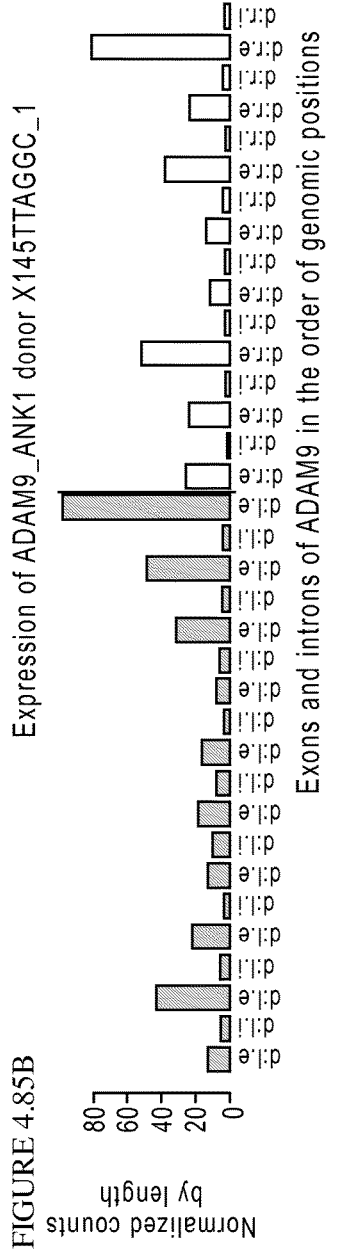
FIGURE 4.85B
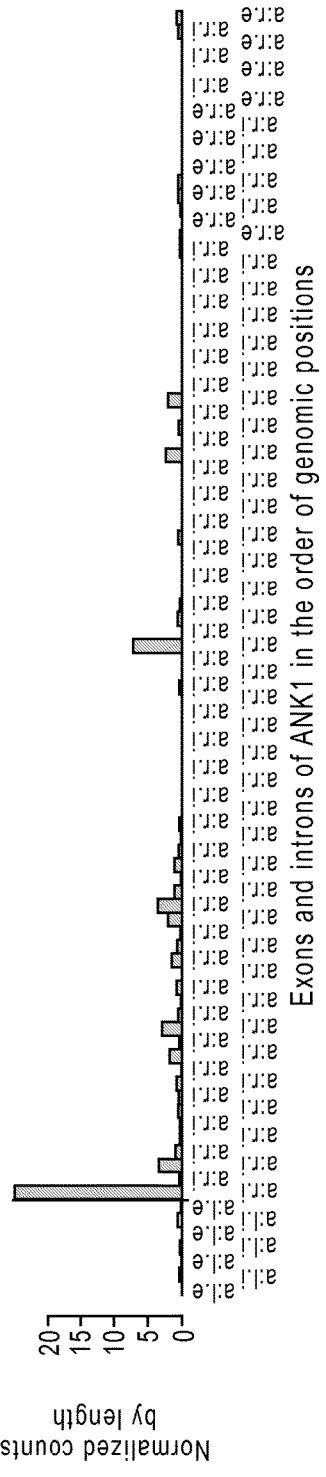
FIGURE 4.85C

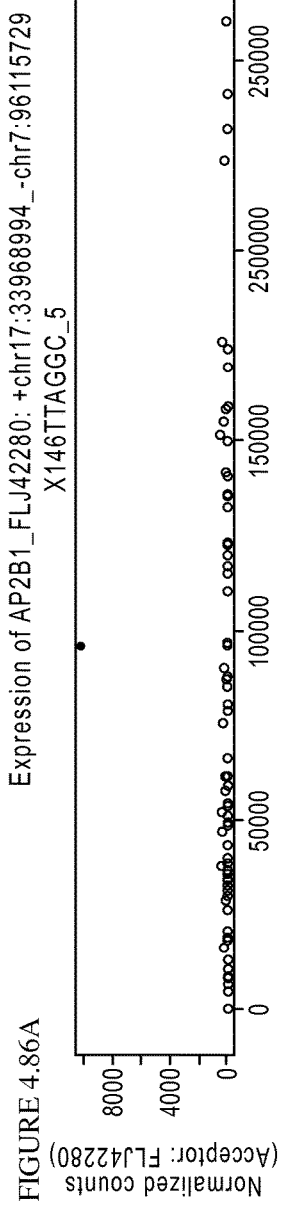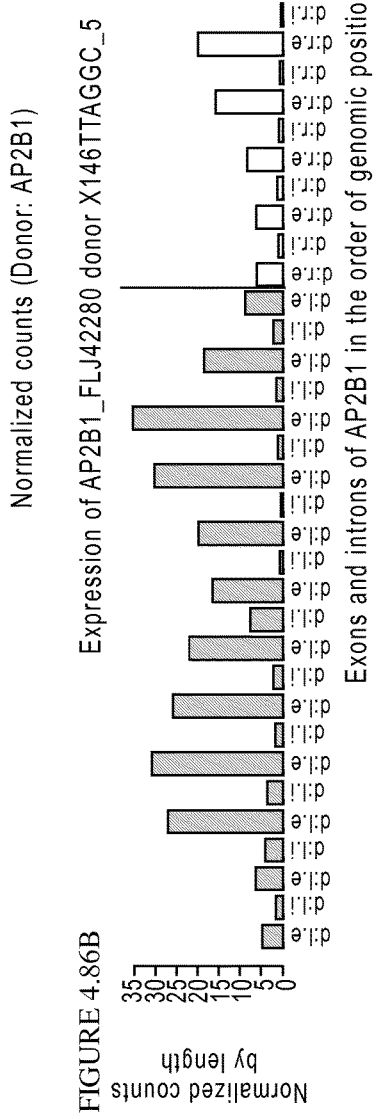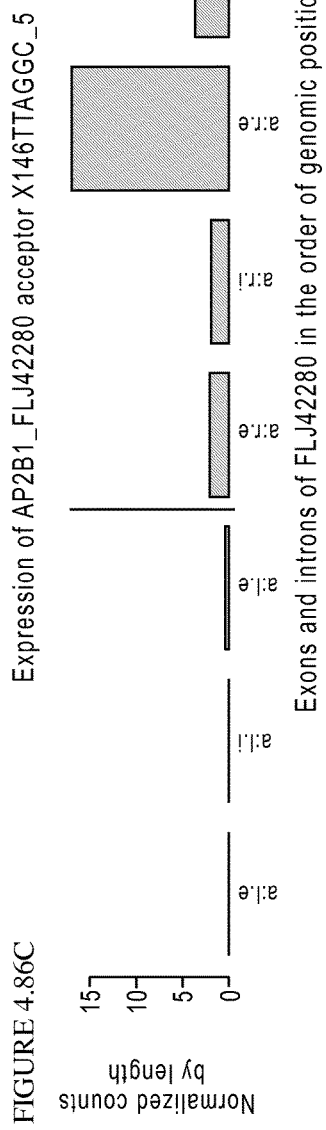
FIGURE 4.86A  FIGURE 4.86B  FIGURE 4.86C

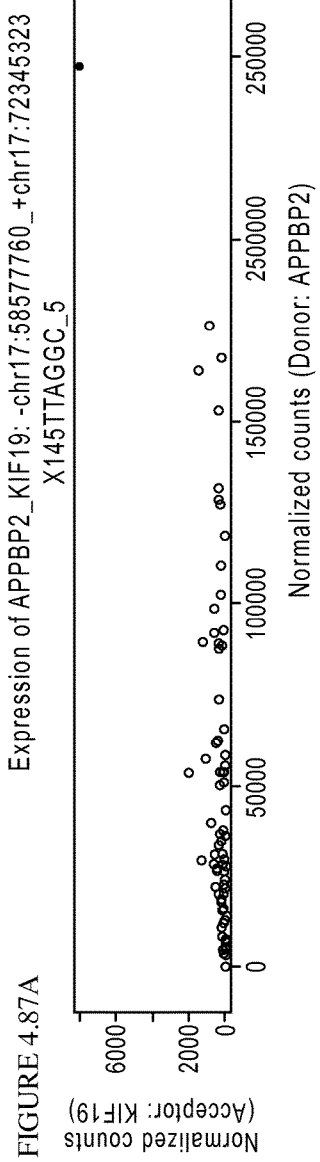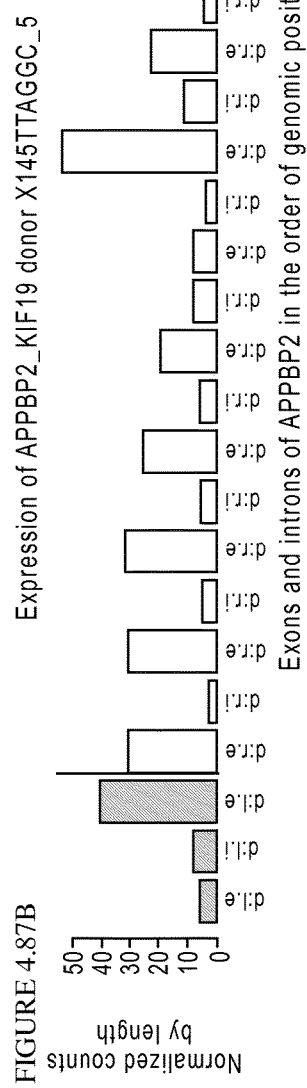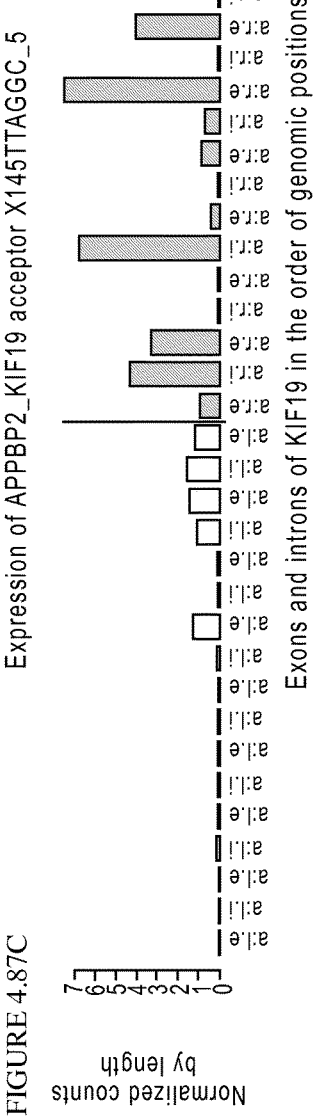
FIGURE 4.87A  FIGURE 4.87B  FIGURE 4.87C

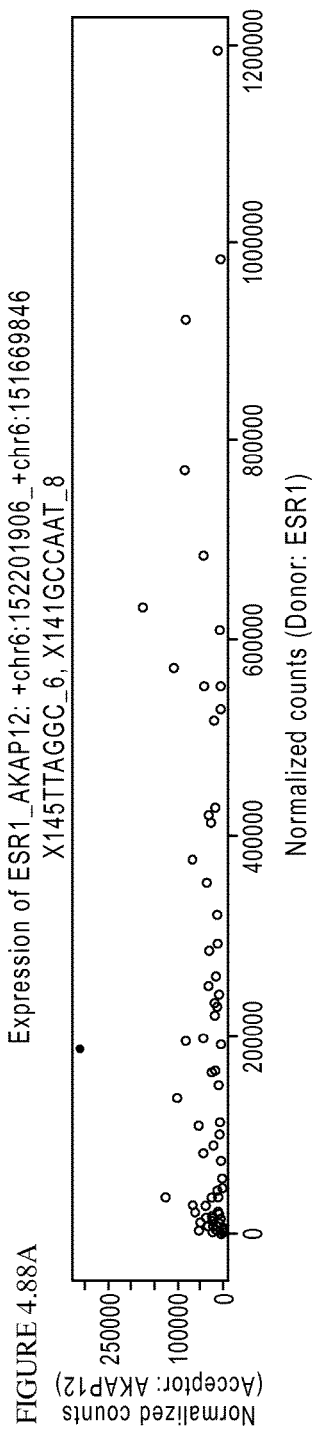
FIGURE 4.88A
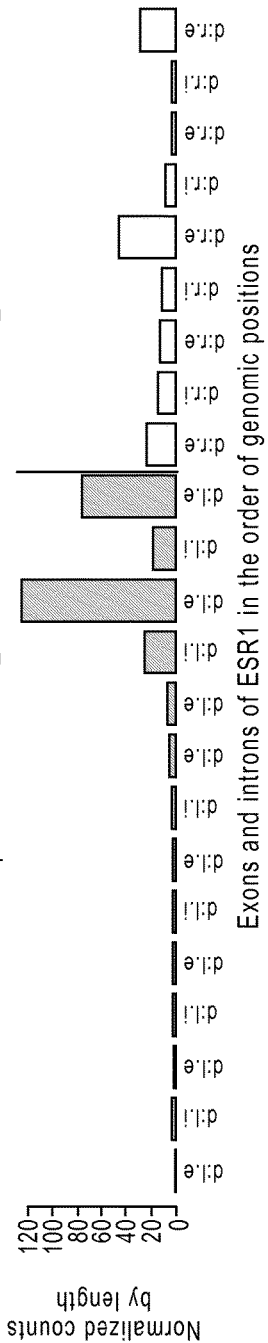
FIGURE 4.88B
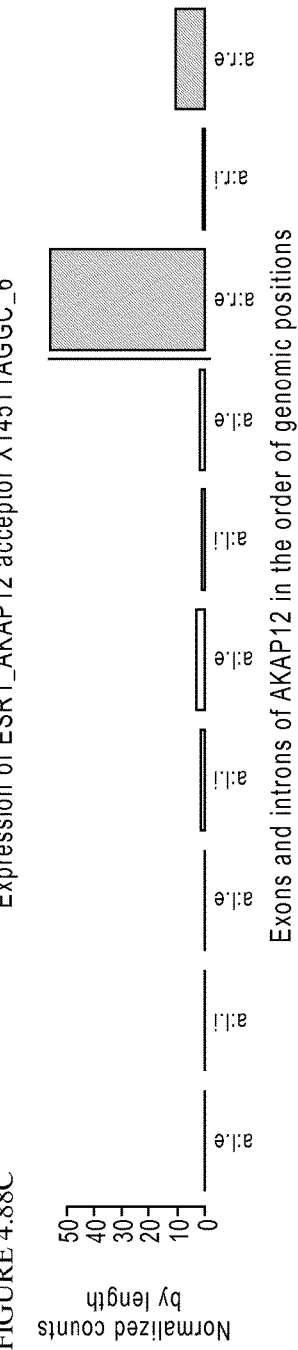
FIGURE 4.88C

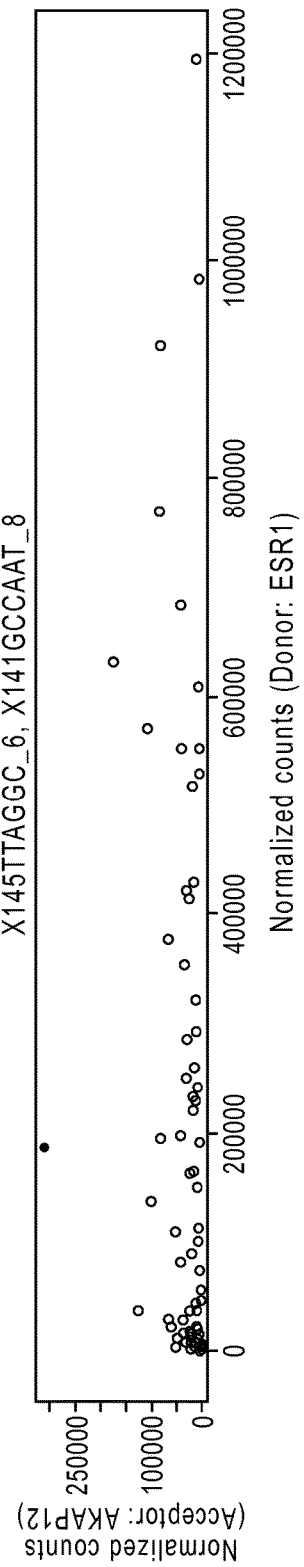
FIGURE 4.89A
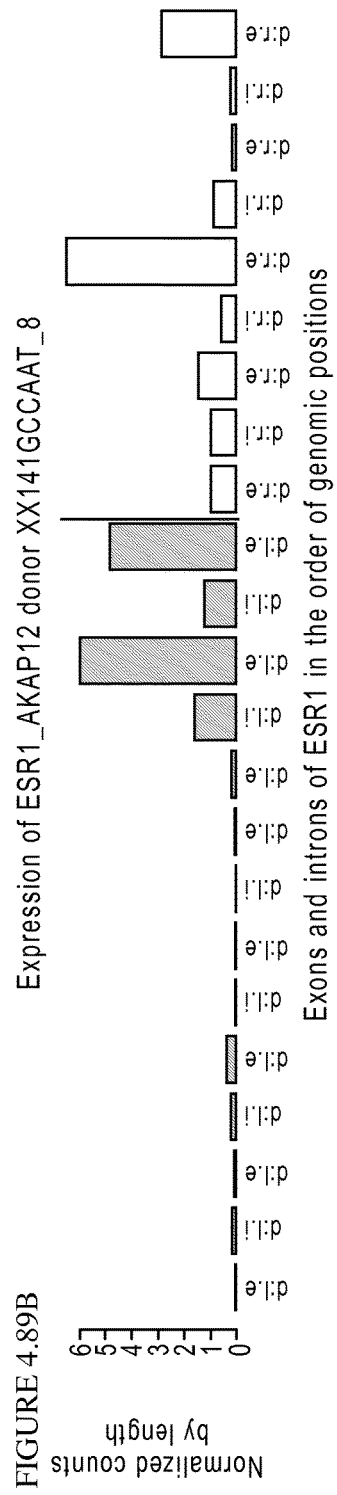
FIGURE 4.89B
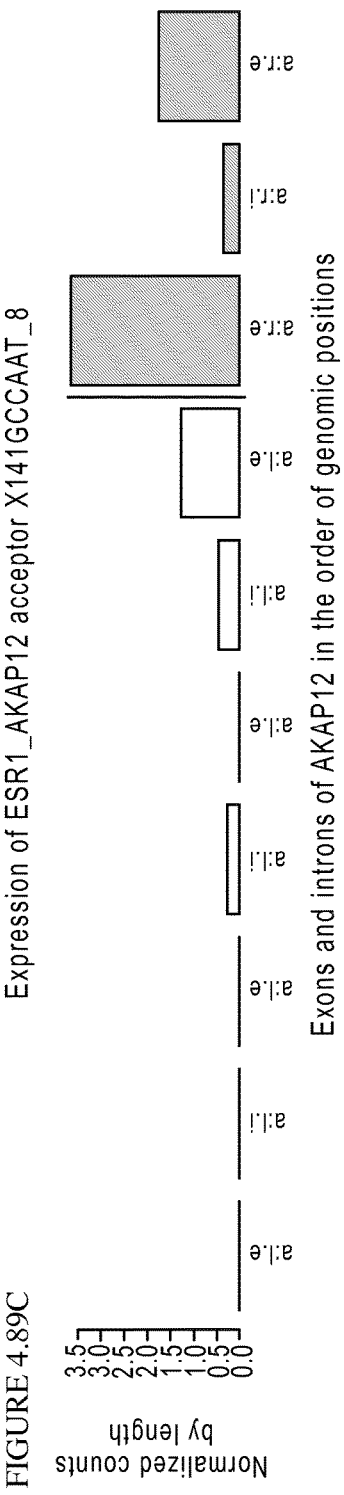
FIGURE 4.89C

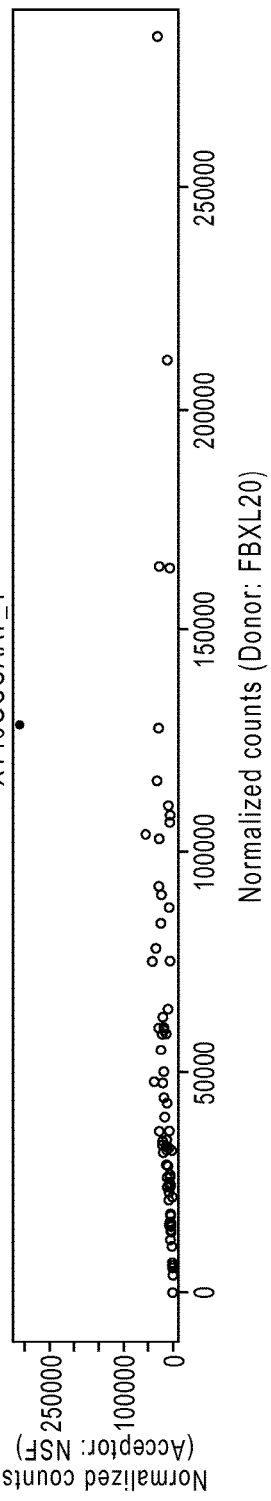
FIGURE 4.90A
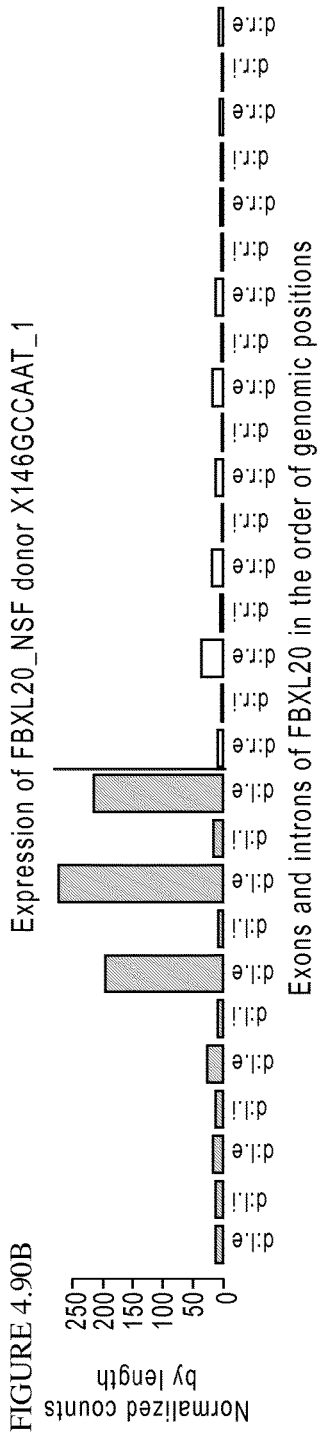
FIGURE 4.90B
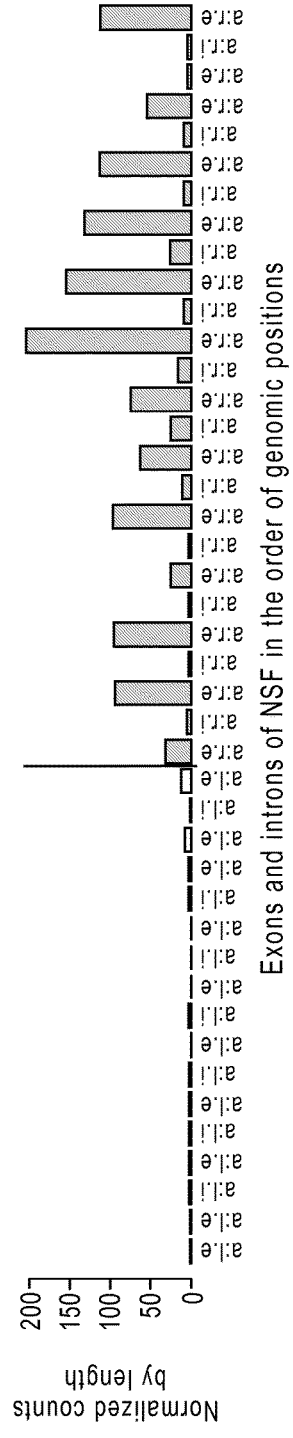
FIGURE 4.90C

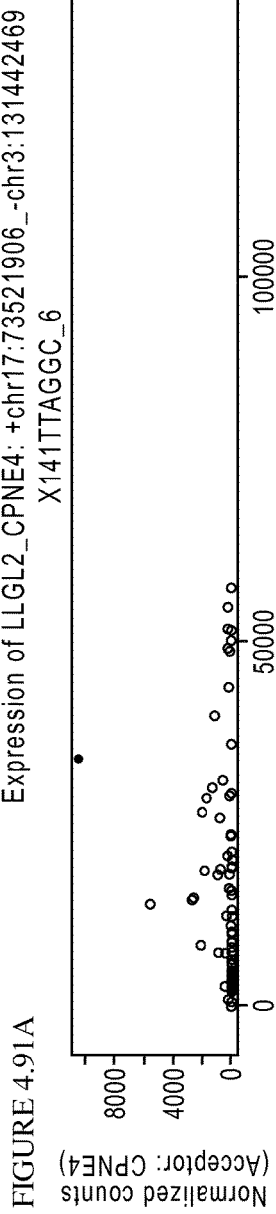
FIGURE 4.91A
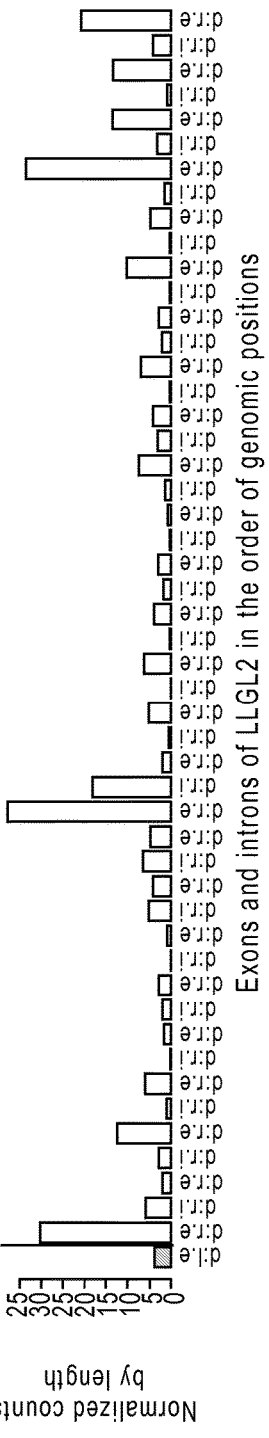
FIGURE 4.91B
FIGURE 4.91C

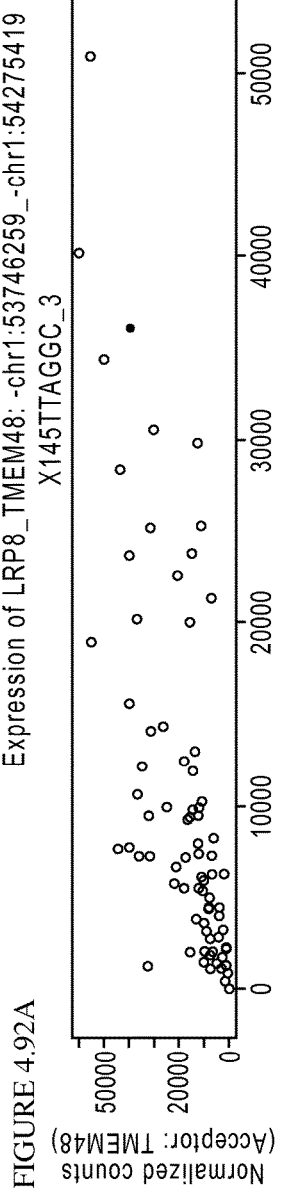
FIGURE 4.92A
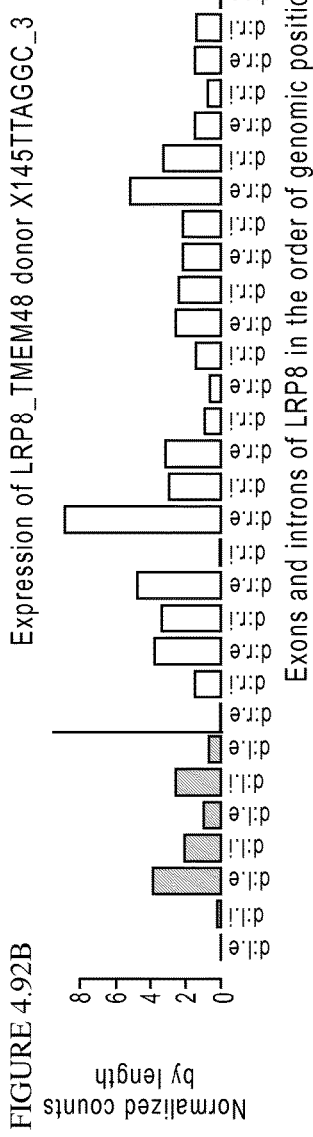
FIGURE 4.92B
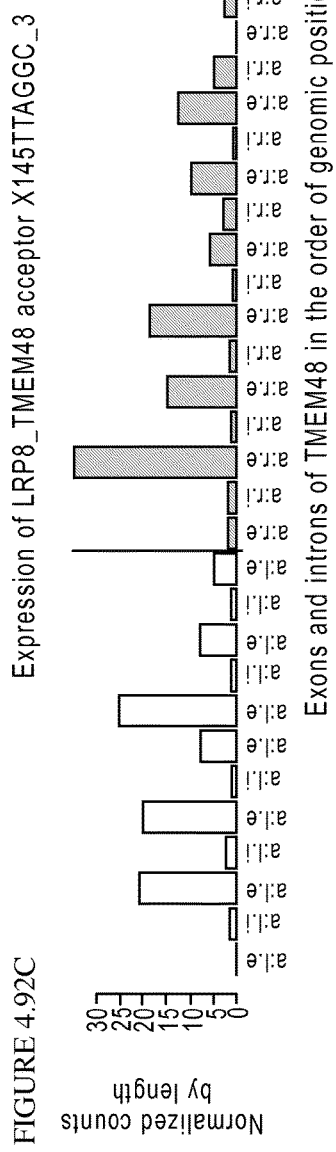
FIGURE 4.92C

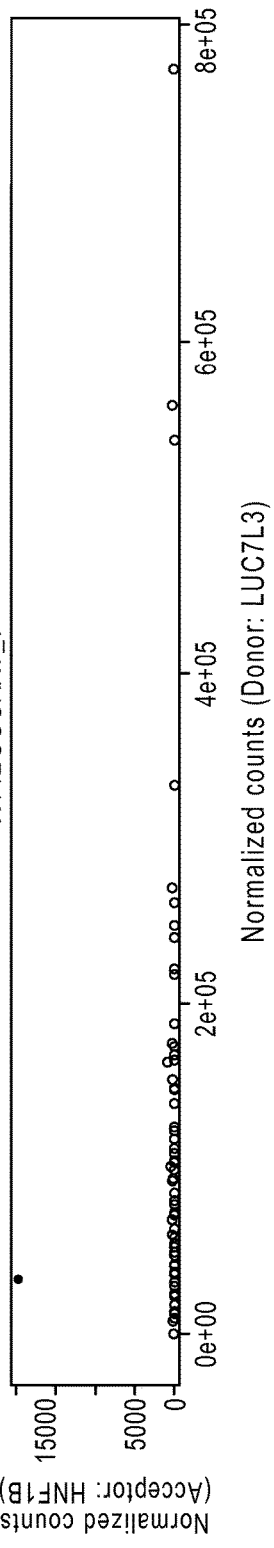
FIGURE 4.93A
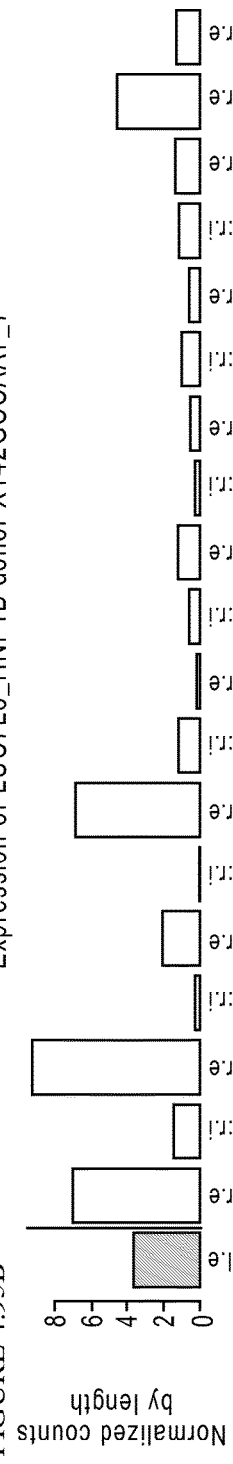
FIGURE 4.93B
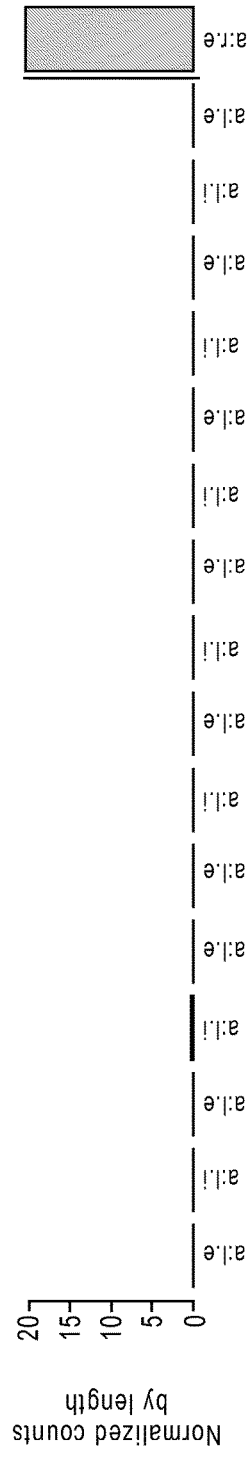
FIGURE 4.93C

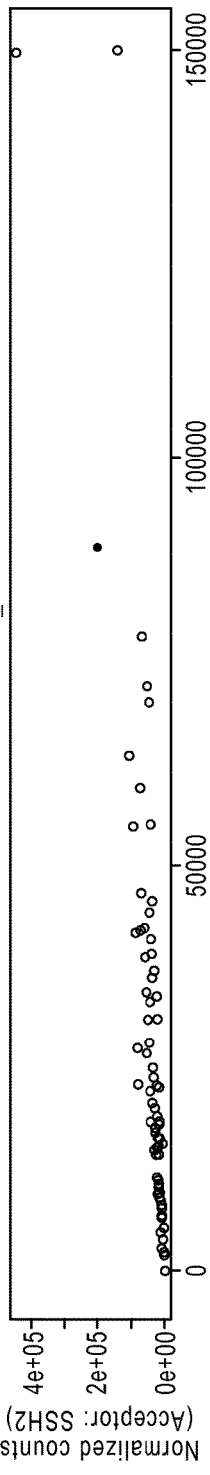
FIGURE 4.94A
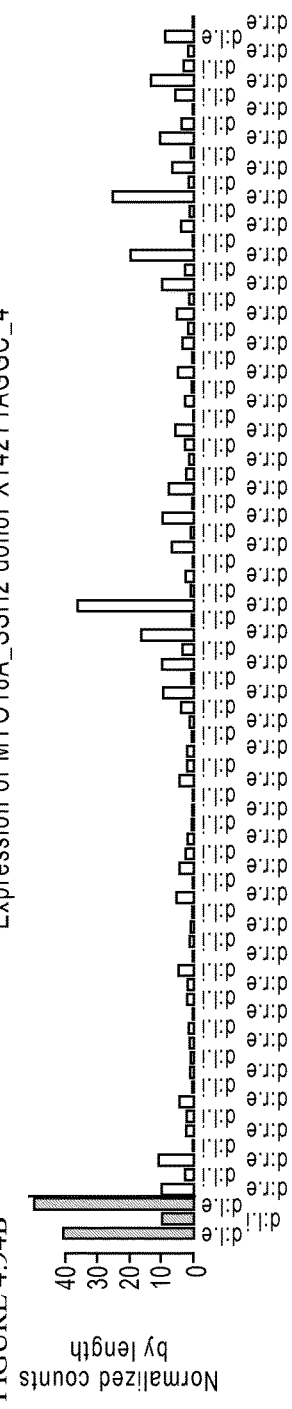
FIGURE 4.94B
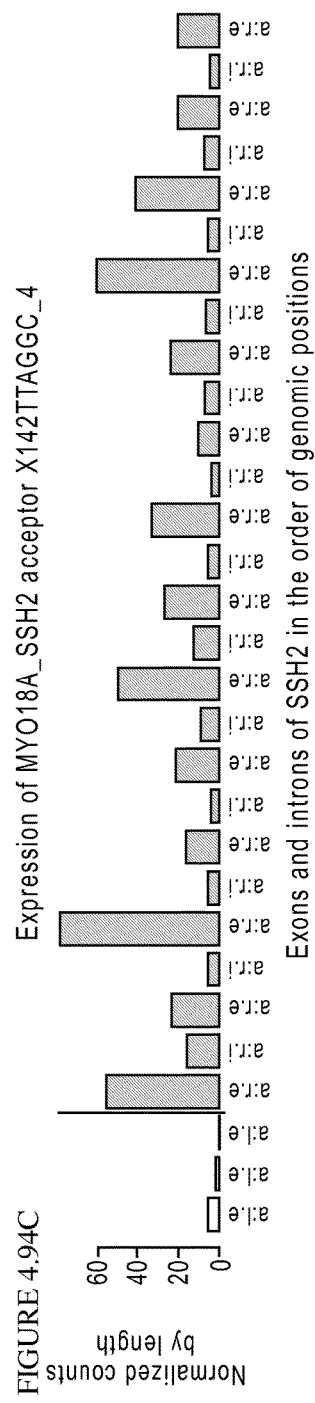
FIGURE 4.94C

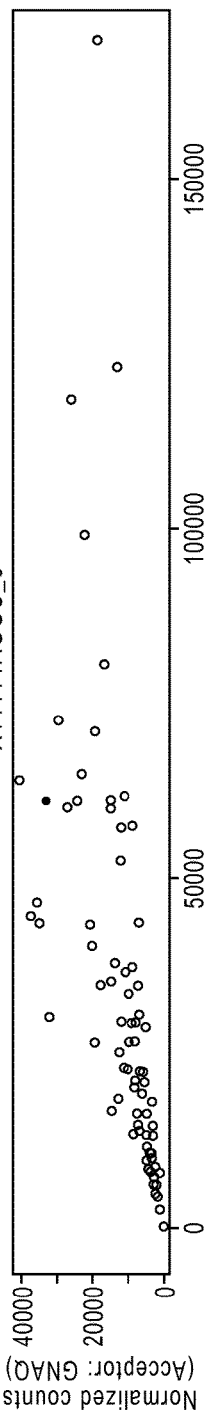
FIGURE 4.95A
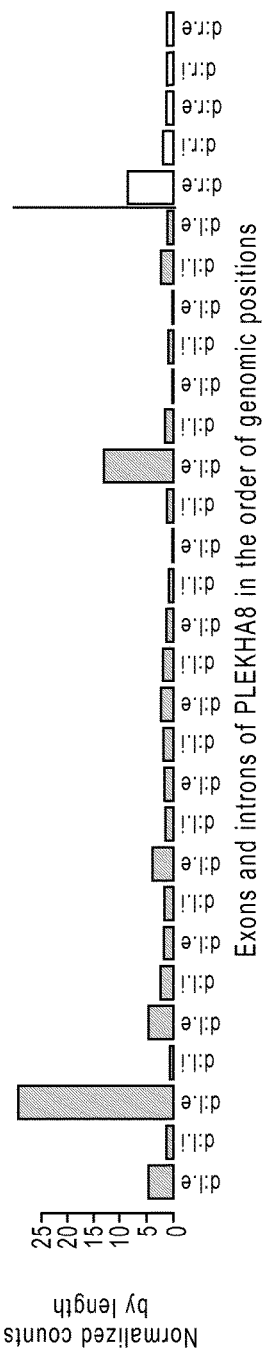
FIGURE 4.95B
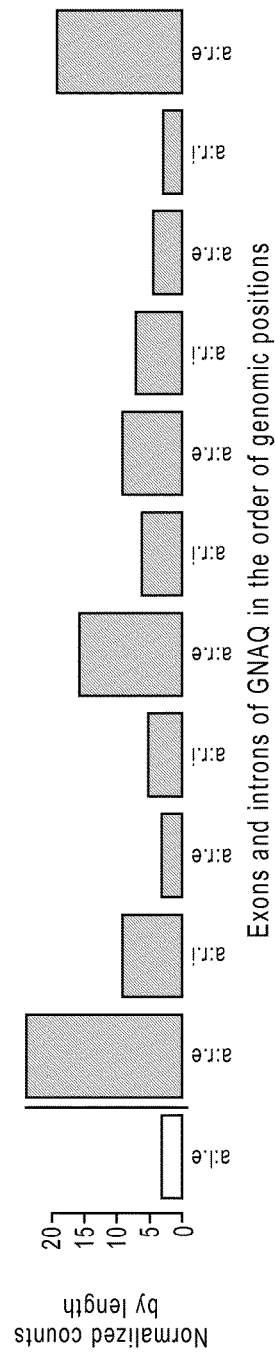
FIGURE 4.95C

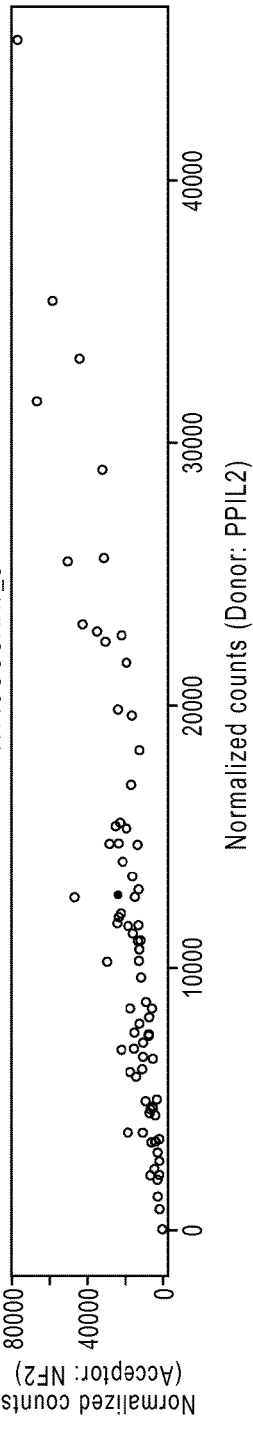
FIGURE 4.96A
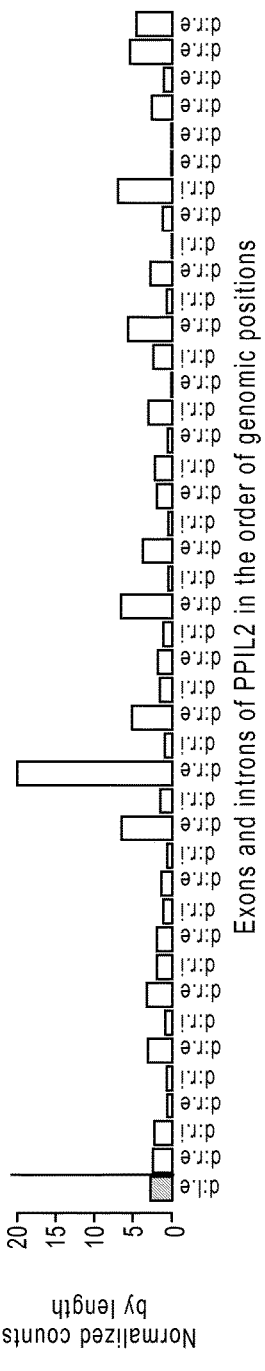
FIGURE 4.96B
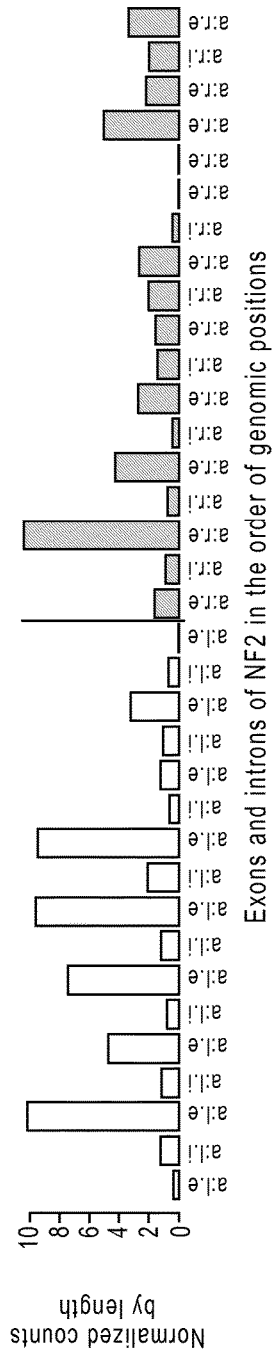
FIGURE 4.96C

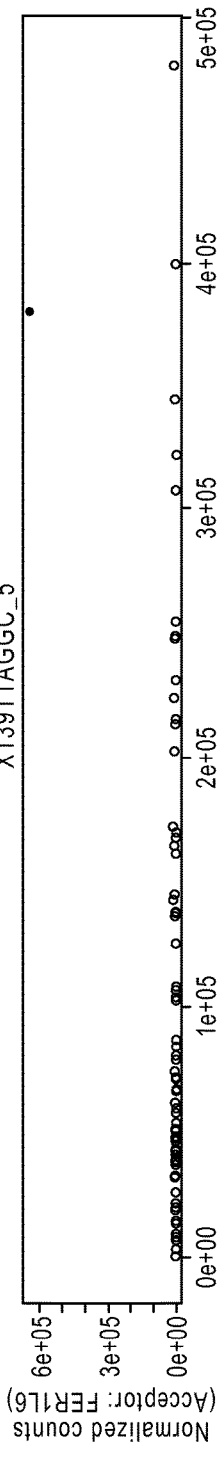
FIGURE 4.97A
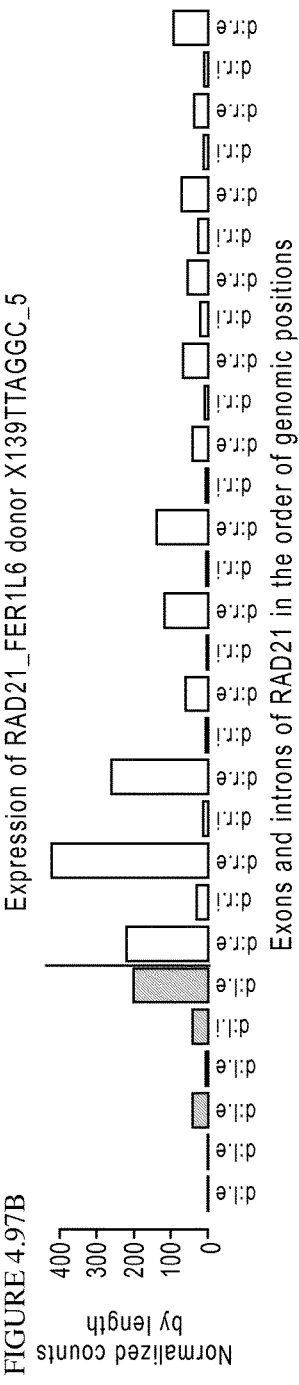
FIGURE 4.97B
FIGURE 4.97C

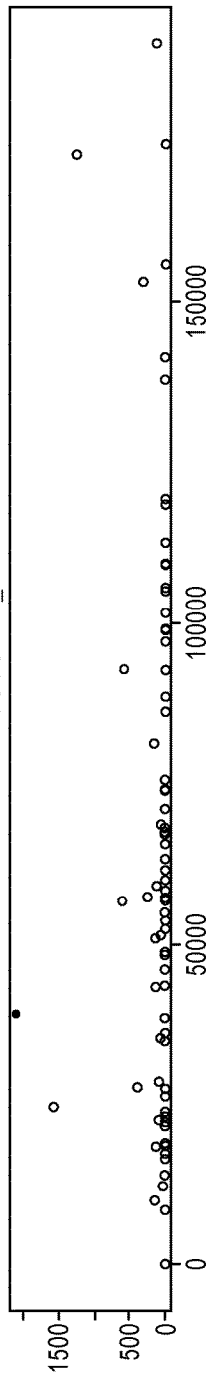
FIGURE 4.98A
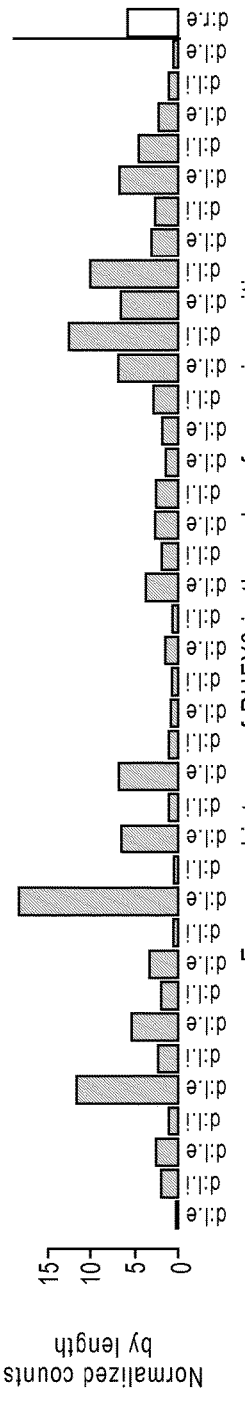
FIGURE 4.98B
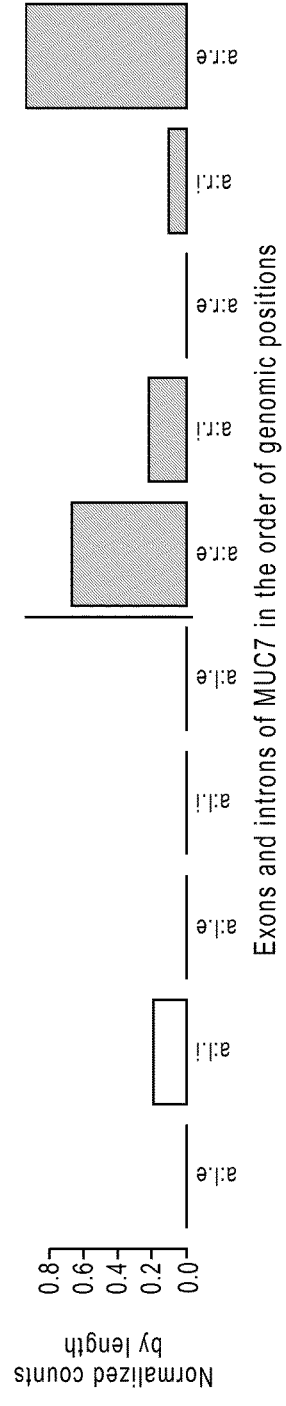
FIGURE 4.98C

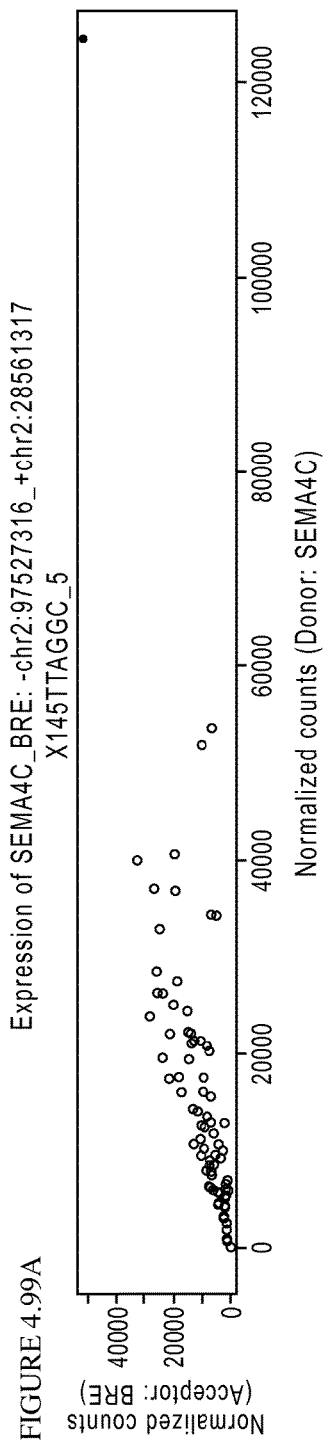
FIGURE 4.99A
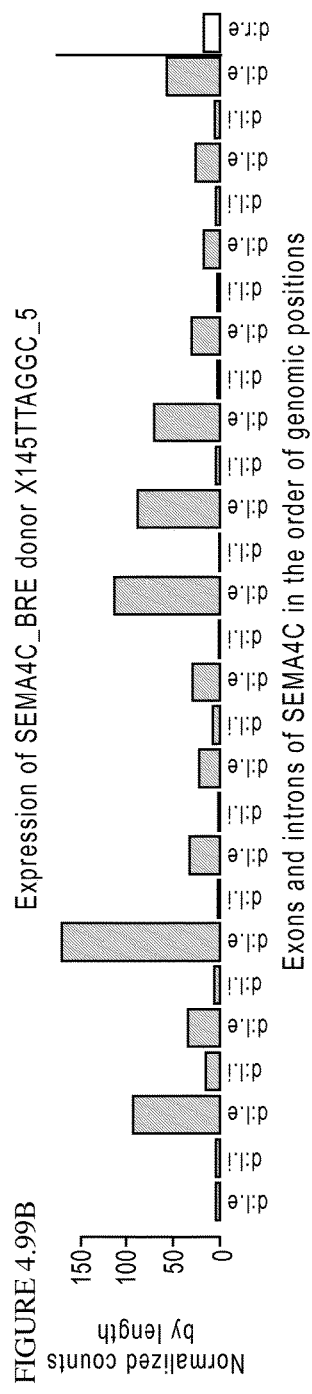
FIGURE 4.99B
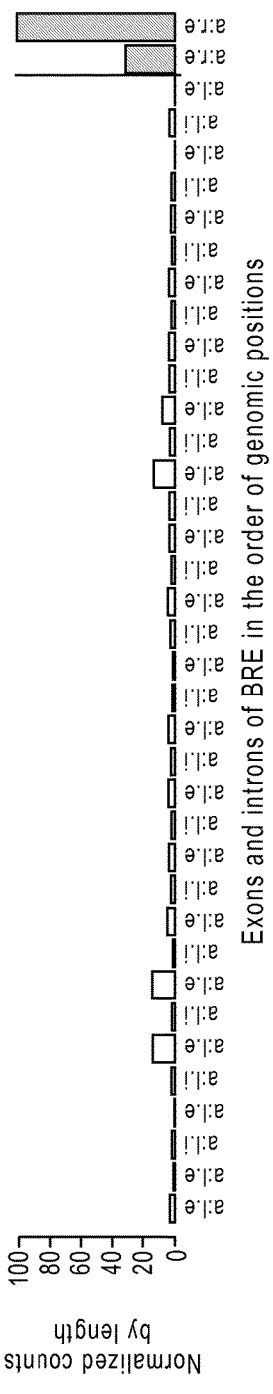
FIGURE 4.99C

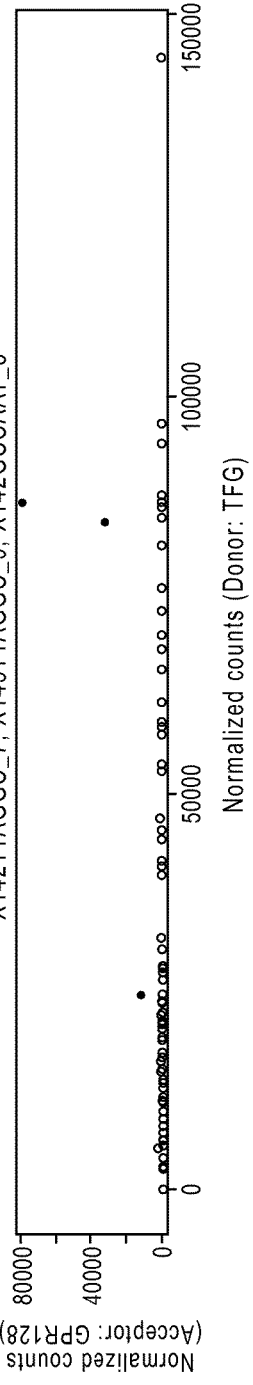
FIGURE 4.100A
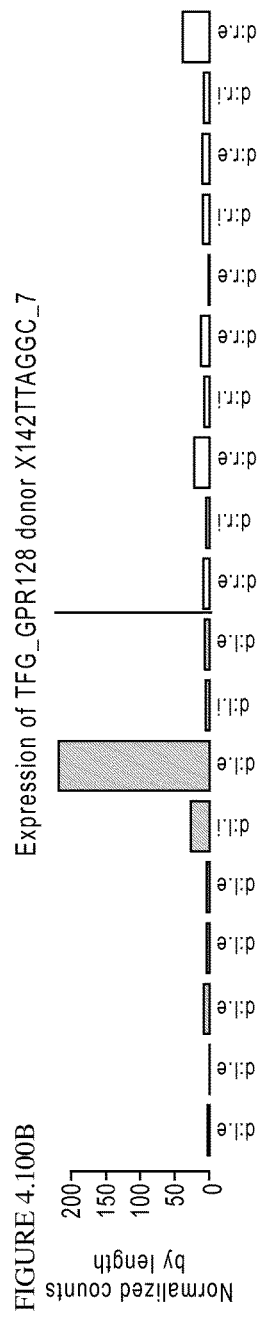
FIGURE 4.100B
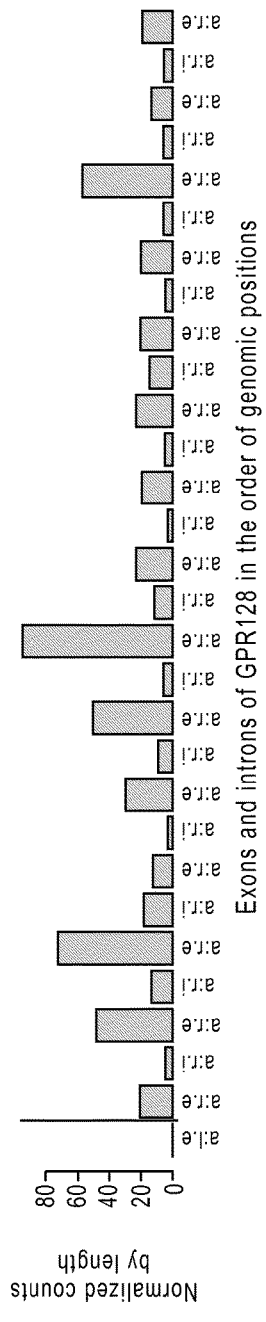
FIGURE 4.100C

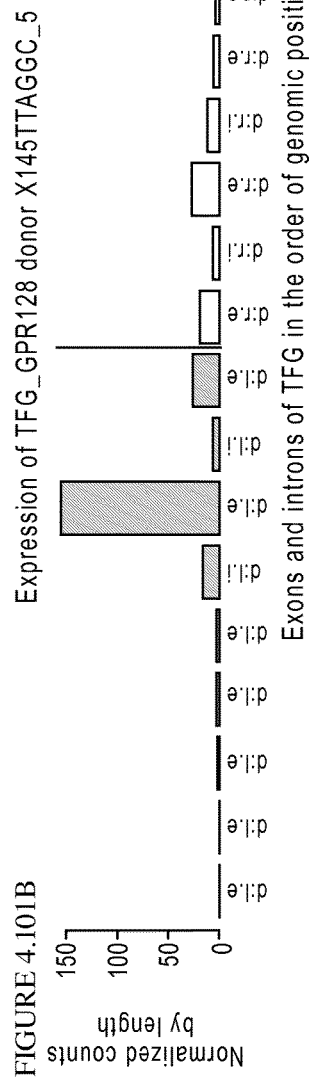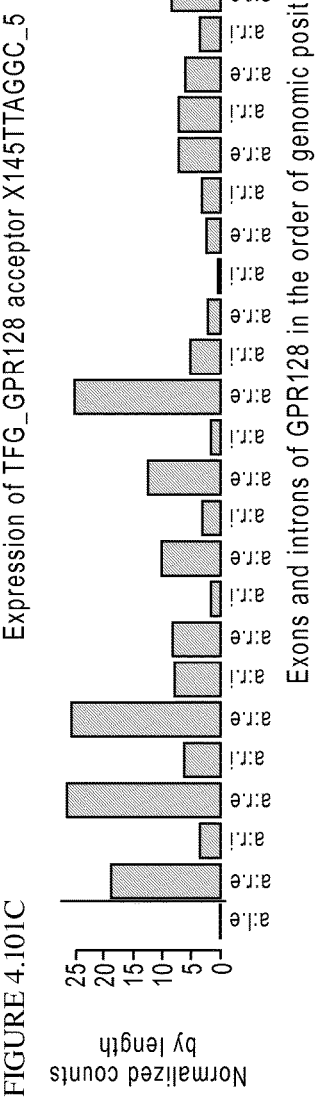
FIGURE 4.101A
FIGURE 4.101B
FIGURE 4.101C

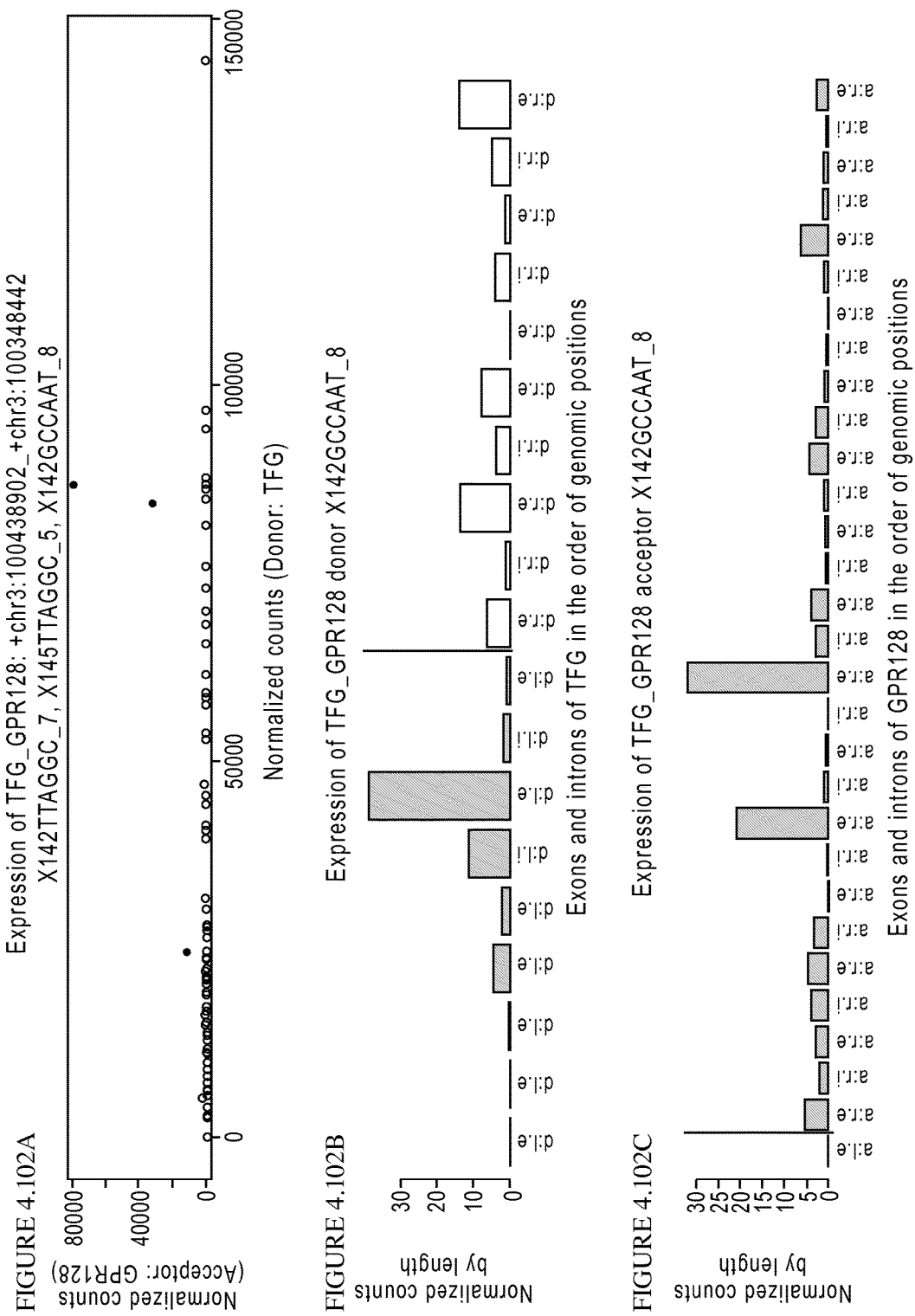

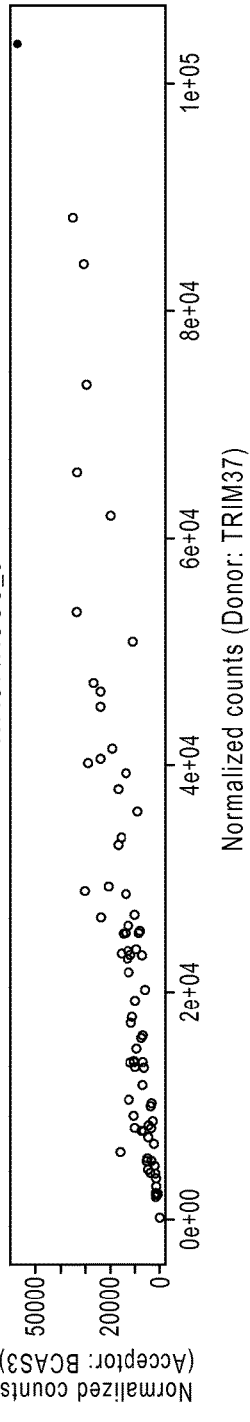
FIGURE 4.103A
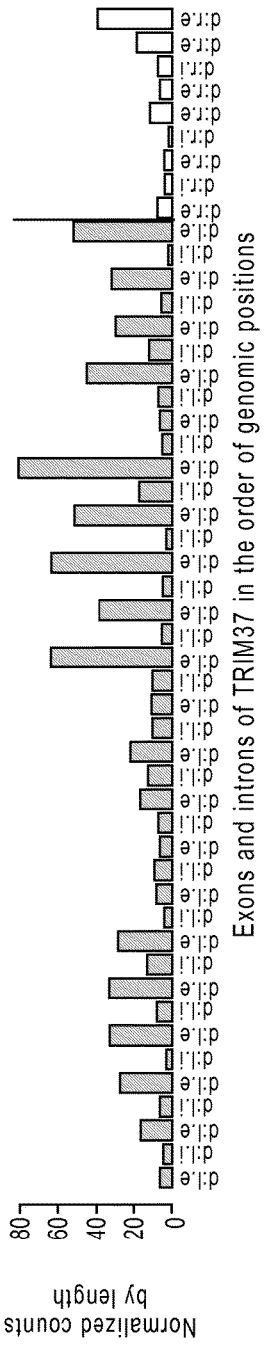
FIGURE 4.103B
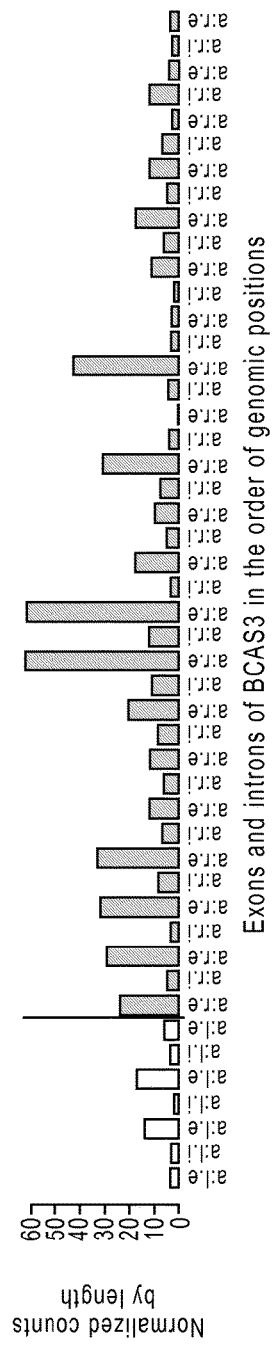
FIGURE 4.103C

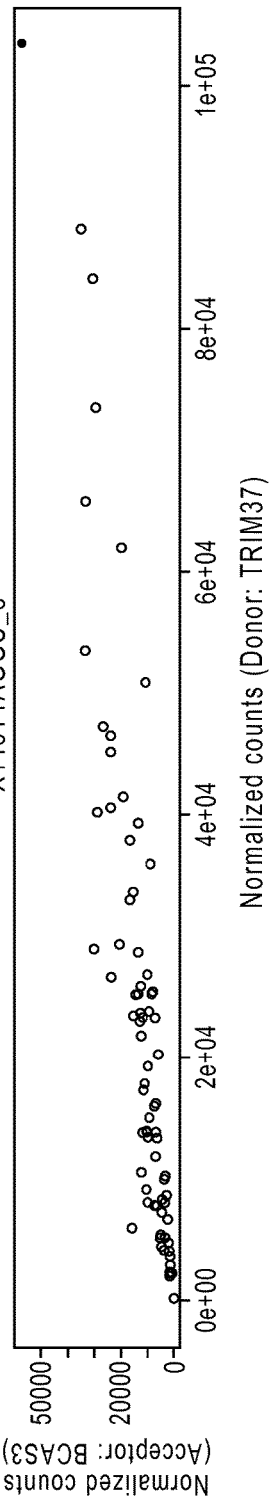
FIGURE 4.104A
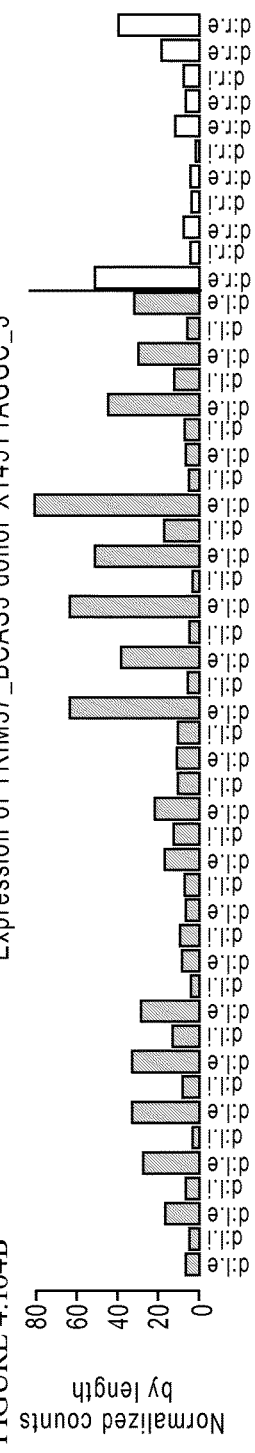
FIGURE 4.104B
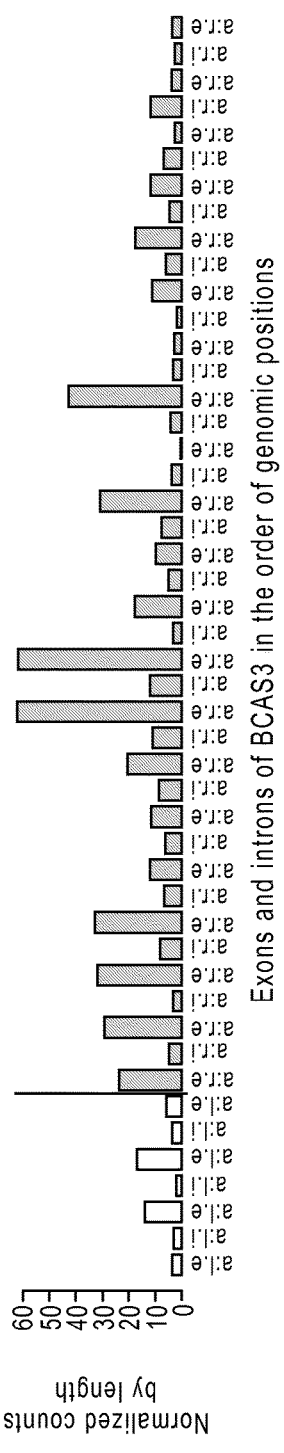
FIGURE 4.104C

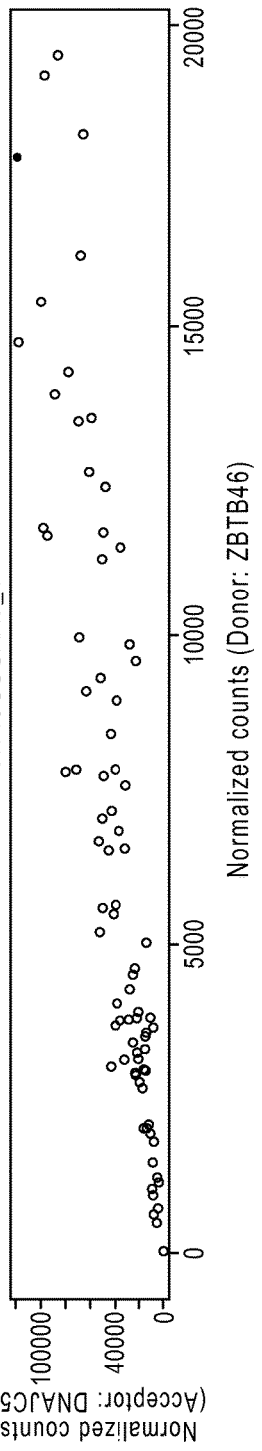
FIGURE 4.105A
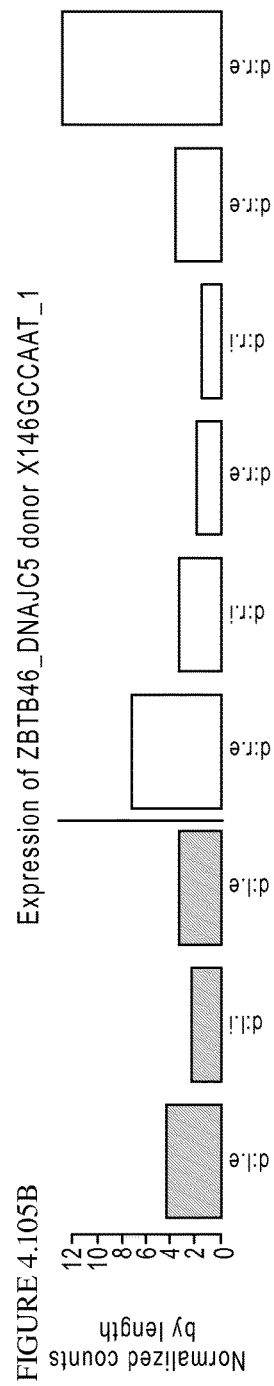
FIGURE 4.105B
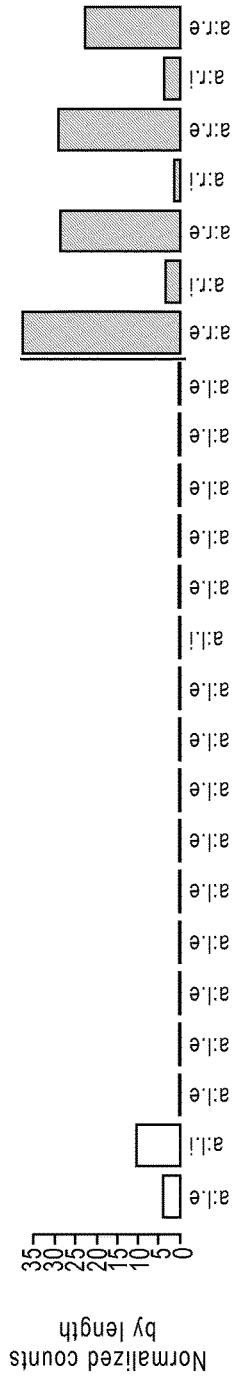
FIGURE 4.105C

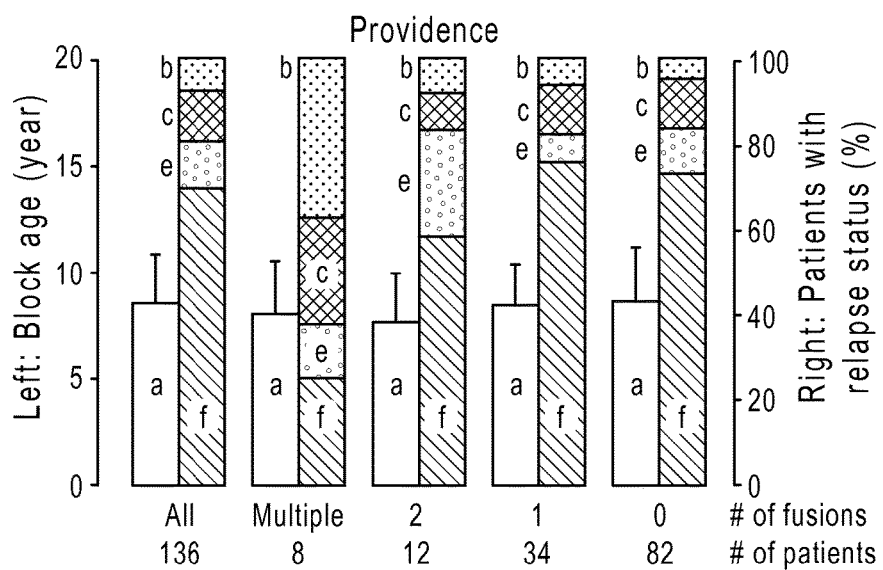
FIGURE 5A1
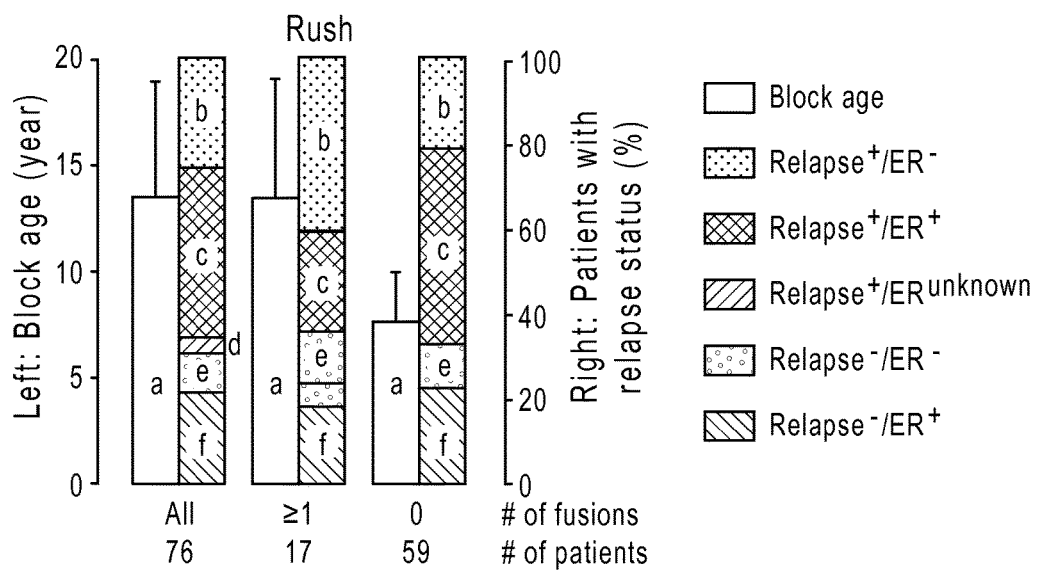
FIGURE 5A2

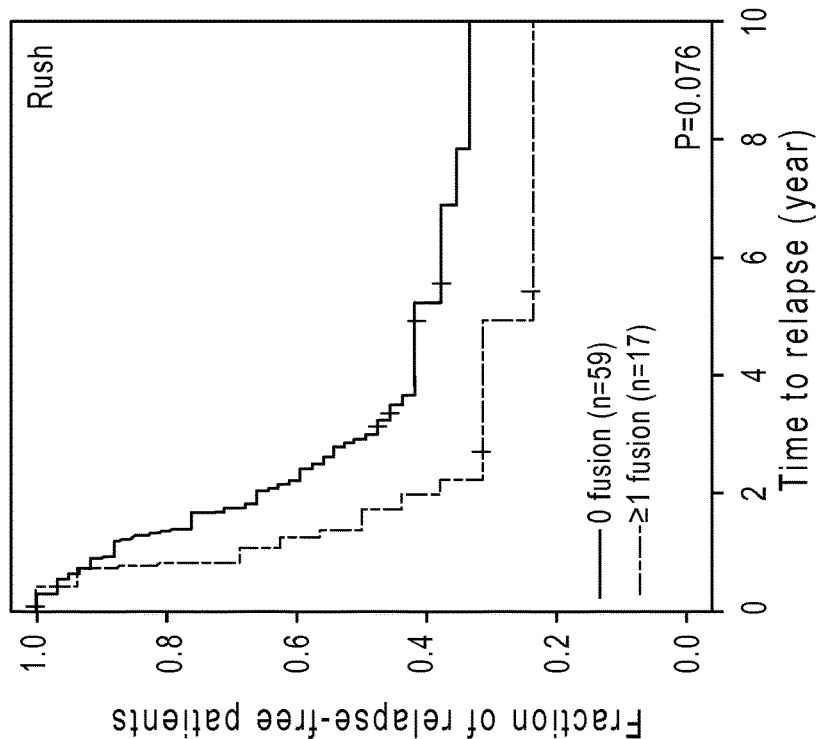
FIGURE 5B2
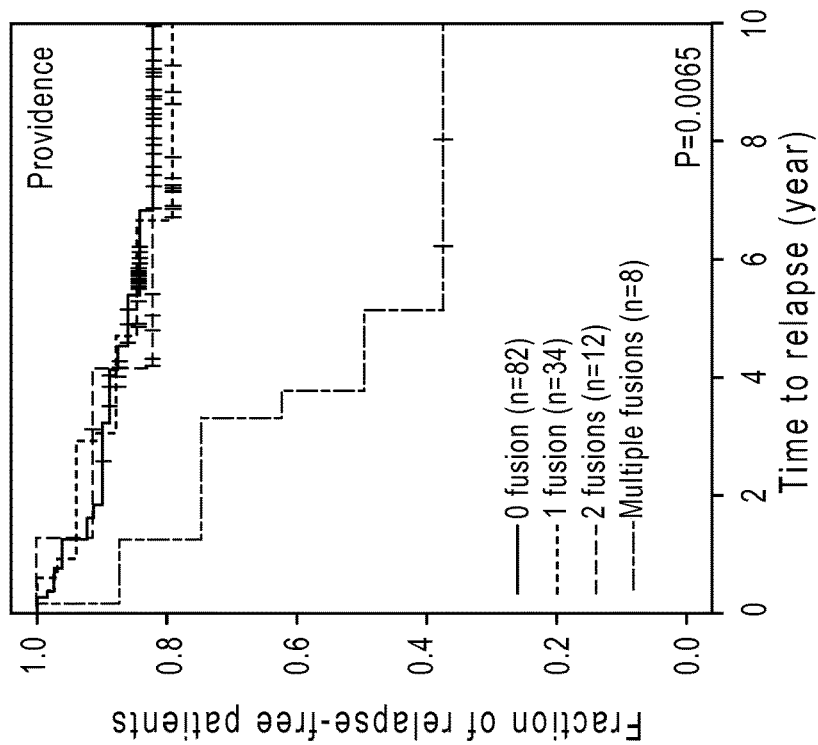
FIGURE 5B1

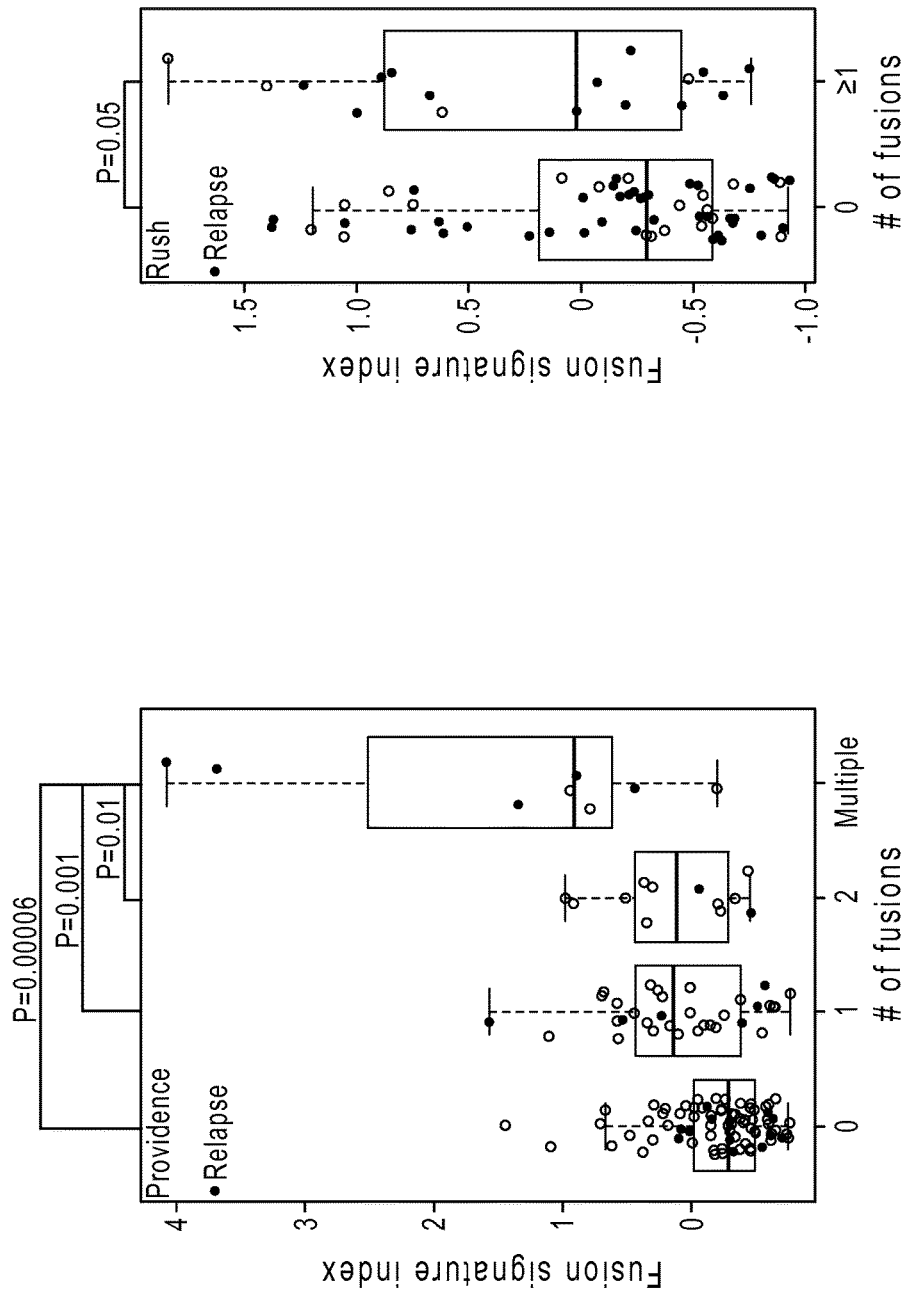
FIGURE 5D2
FIGURE 5D1

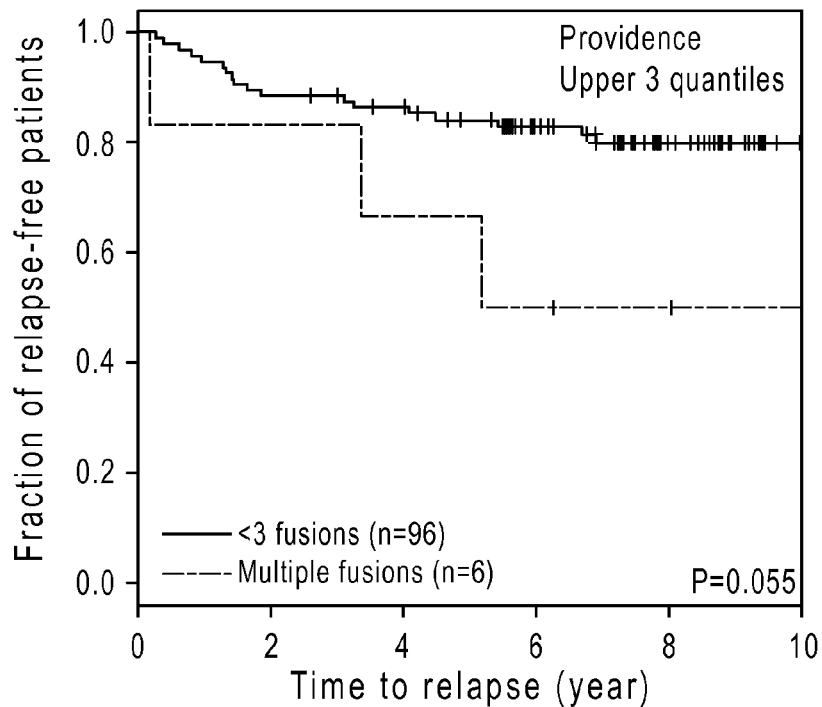
FIGURE 6A1
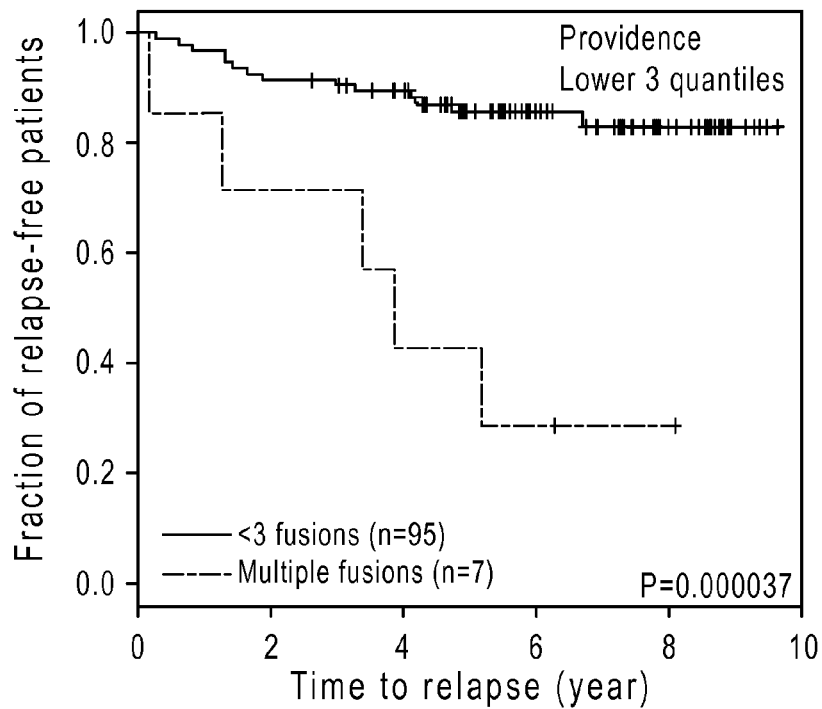
FIGURE 6A2

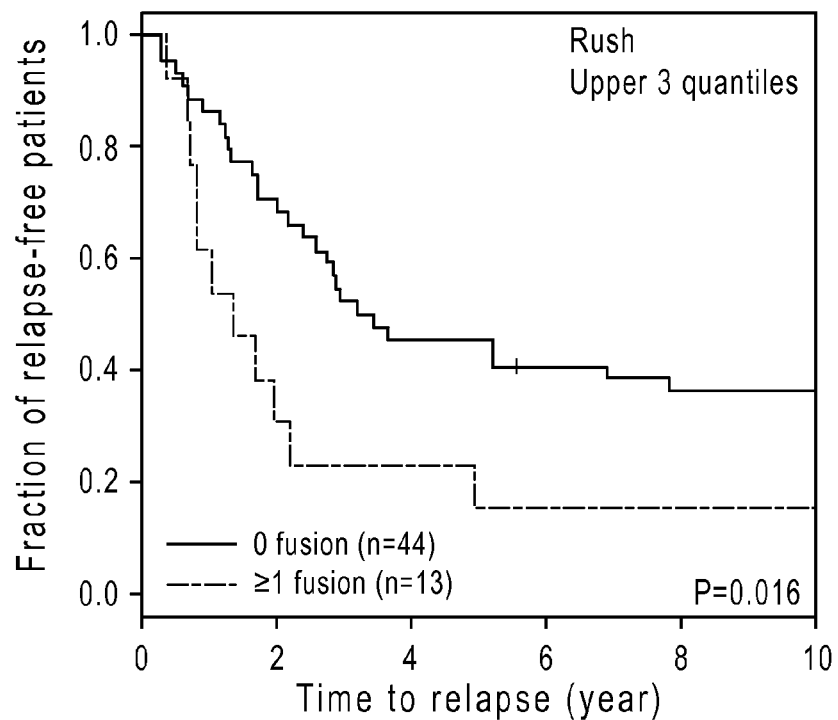
FIGURE 6B1
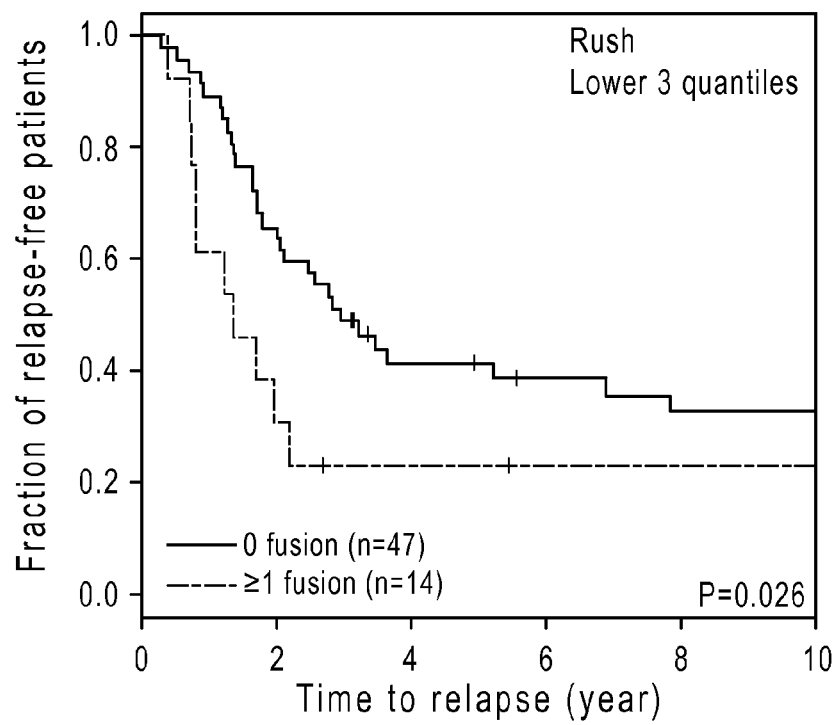
FIGURE 6B2

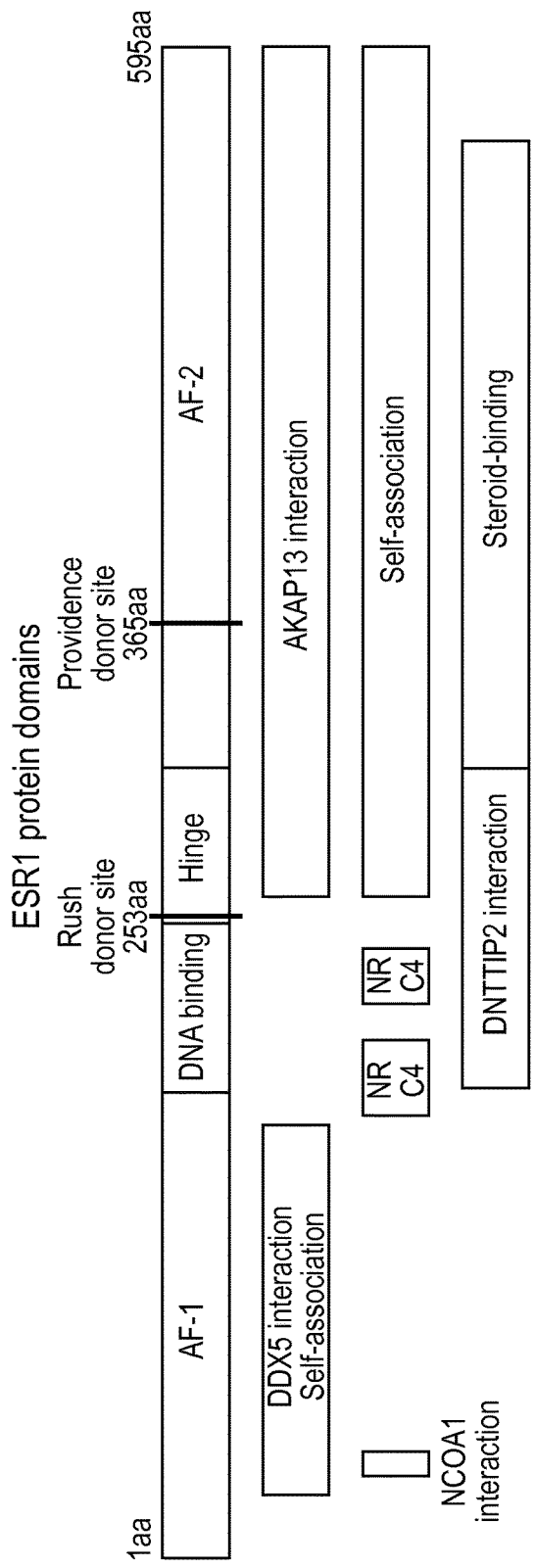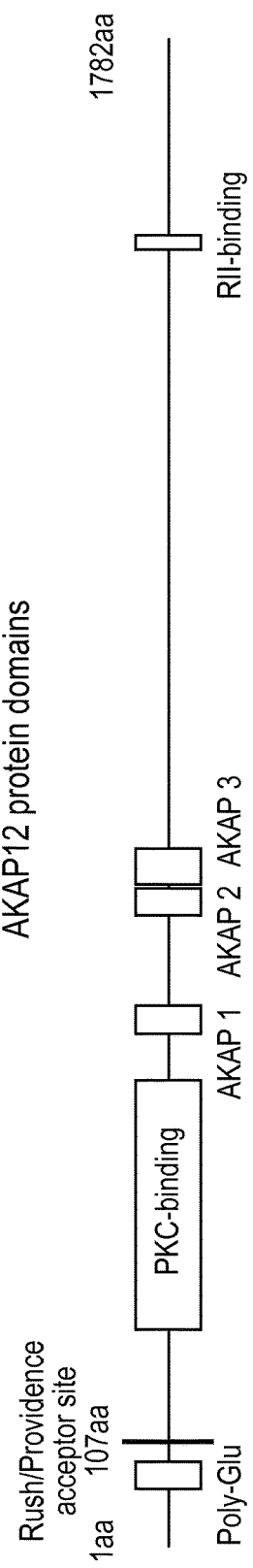
FIGURE 9A
FIGURE 9B

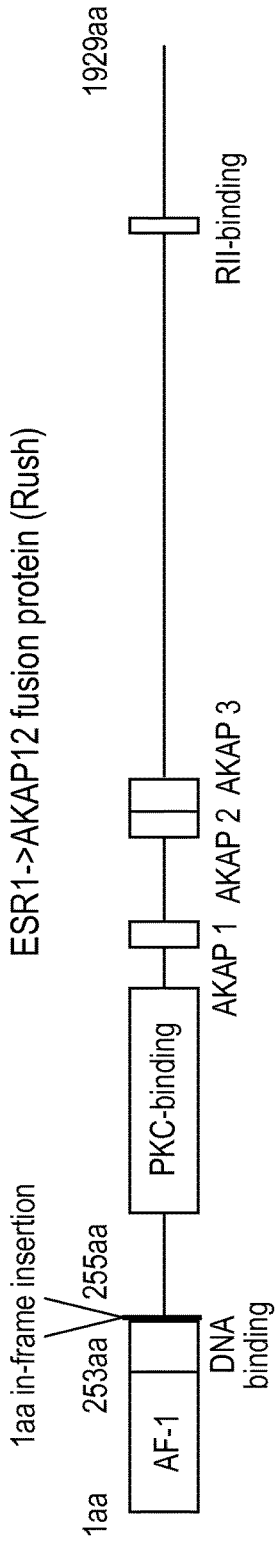
FIGURE 9C1
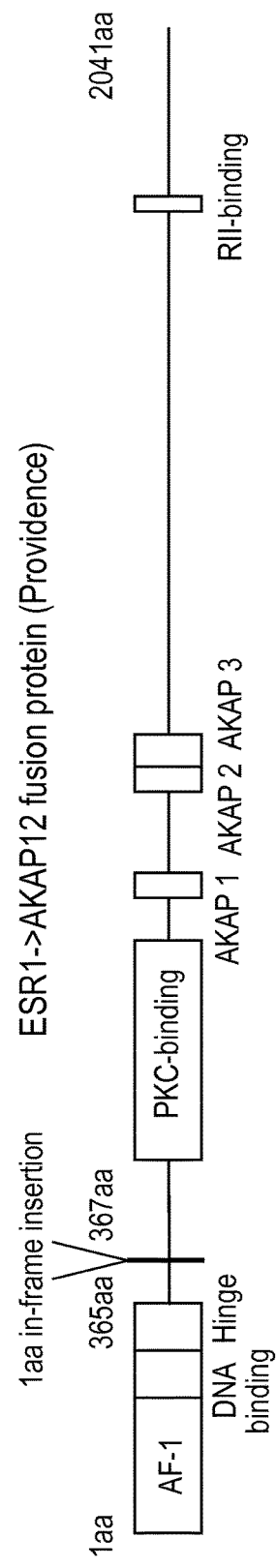
FIGURE 9C2

GENE FUSIONS AND ALTERNATIVELY SPLICED JUNCTIONS ASSOCIATED WITH BREAST CANCER

This application is a national phase application under 35 U.S.C. § 371 of International Application No. PCT/US2013/068236, filed Nov. 4, 2013, and claims the benefit under 35 U.S.C. § 119(e) of U.S. Provisional Application No. 61/722,634, filed Nov. 5, 2012, and U.S. Provisional Application No. 61/766,561, filed Feb. 19, 2013, the disclosures of which are hereby incorporated herein by reference in their entirety.

SEQUENCE LISTING

The instant application contains a Sequence Listing which has been submitted electronically in ASCII format and is hereby incorporated by reference in its entirety. Said ASCII copy, created on Oct. 24, 2013, is named GHI-0056-PCT-_SL.txt and is 1,261,876 bytes in size.

FIELD OF THE INVENTION

The present invention relates to gene fusions and genes comprising alternative spliced junctions associated with breast cancer. The present invention also relates to methods of identifying gene fusions and genes comprising alternative spliced junctions in samples obtained from a patient with cancer. Furthermore, the present invention relates to method of predicting the prognosis of a patient with breast cancer based on the number of gene fusion events.

INTRODUCTION

Genomic aberrations resulting in gene fusions and alternatively spliced genes play an important role in cancer. Gene fusions, for example, have been estimated to account for about 20% of human cancer morbidity. Mitelman et al., *Nature Reviews Cancer* 7:233-245 (2007). Gene fusions are hybrids created by joining two previously separate genes via genomic aberrations such as translocations, deletions, and inversions, or trans-splicing between precursor mRNAs. Gene fusions may up-regulate expression of oncogenic genes by fusing a strong promoter to an oncogene. The first gene fusion identified in human neoplasia was BCR-ABL1 in chronic myelogenous leukemia (CML). The protein resulting from this fusion exhibits constitutive tyrosine kinase activity. Discovery of BCR-ABL1 led to development of a targeted treatment for CML using the tyrosine kinase inhibitor imatinib, which was approved in 2001. Druker et al., *New England Journal of Medicine* 344:1038-1042 (2001). Most of the known gene fusions have been found in hematological disorders; however, with the advent of next-generation sequencing technology, rare recurrent gene fusion events have been identified in common solid tumors. See Kohno et al., (2012) *Nature Medicine* 18: 375-377 (2012); Takeuchi et al., *Nature Medicine* 18: 378-381 (2012); Lipson et al., *Nature Medicine*, 18: 382-384 (2012); and Ju, et al., *Genome Res.*, 22: 436-445 (2012).

In cancer, aberrantly spliced pre-mRNAs escape the quality control mechanisms within cells (e.g., the nonsense mediated mRNA decay pathway) and are, therefore, translated into aberrant proteins. He et al., *PLoS ONE* 4(3):e4732 (2009). For example, alternative splicing is known to be related to the pathogenesis of colon cancer and has been described to occur in lung adenocarcinoma. Seo et al., *Genome Research* 1-11 (October 2012).

Transcriptome sequencing enables detection of transcriptional variants such as gene fusions and alternative splicing events. Current methods, such as ChimeranScan (Robinson, et al., *Nature Medicine* 17: 1646-1651 (2011)), SnowShoes-FTD (Asmann et al., *Cancer Res,* 72: 1921-1928 (2012)), GSTRUCT-fusions (Seshagiri, S. et al., *Nature* 488: 660-664 (2012)), and GFP (Ju et al., *Genome Res.,* 22: 436-445 (2012)), use paired-end data obtained from fresh frozen tissue samples to detect gene fusions. Other methods, such as TopHat-Fusion (Kim and Salzberg, *Genome Biol* 12: R72 (2011)), FusionMap (Ge et al. *Bioinformatics,* 27: 1922-1928 (2011)), and FusionFinder (Francis et al. *PLoS One,* 7(6):e39987 (2012)) can use single-end data from cell lines or fresh frozen tissue samples to detect gene fusions.

Because standard clinical practices include generating formalin-fixed, paraffin-embedded (FFPE) tissue samples from biopsies and surgical resections, FFPE samples provide an enormous repository of information for cancer research. Nonetheless, current methods are not well suited for investigating RNA from FFPE samples as the RNA from such samples is often degraded and libraries generated from those samples have low complexity and small insert sizes.

The present bioinformatics approaches identify gene fusions and alternative spliced junctions from FFPE RNA-sequencing datasets at base-pair resolution.

SUMMARY

A bioinformatics approach was developed to identify gene fusion junctions using FFPE RNA-sequencing datasets. The present invention provides gene fusion junctions that are present in breast cancer tissue samples. These gene fusions are provided in Tables A and B. The present invention also provides a bioinformatics approach to identify alternative spliced junctions. The present invention provides alternative spliced junctions that are present in breast cancer tissue samples. These alternative spliced junctions are present in Table 5.

The present invention accommodates the use of archived paraffin-embedded biopsy material for assay of gene fusion transcripts, and therefore is compatible with the most widely available type of biopsy material. It is also compatible with other different methods of tumor tissue harvest, for example, via core biopsy or fine needle aspiration.

A multiplexed, whole genome sequencing methodology was used to enable whole transcriptome-wide gene fusion and alternative spliced junction discovery using low amounts of FFPE tissue. The methods described herein support the use of single end or paired end sequence reads.

In one aspect, the invention provides a method for identifying a gene fusion in a biological sample obtained from a patient with cancer. The method comprises obtaining a plurality of reads from RNA sequencing of the biological sample. The read is then mapped to the human genome. Next, the method comprises determining whether the read comprises a distant spliced junction and selecting the read comprising a distant spliced junction. A candidate gene fusion comprising the distant spliced junction is then identified. The method also comprises creating a first set of templates for the candidate gene fusion. The first set of templates comprises: (1) a fusion template comprising 50 base pairs (bp) of exonic sequence of a preserved region of a donor gene and 50 bp of exonic sequence of a preserved region of an acceptor gene, (2) a donor template comprising 50 bp of exonic sequence of a preserved region of a donor gene and 50 bp of exonic sequence of a discarded region of an donor gene, (3) an acceptor template comprising 50 bp of exonic sequence of a discarded region of a acceptor gene and 50 bp of exonic sequence of a preserved region of an acceptor gene, (4) a donor genomic template comprising 50 bp upstream genomic sequence of a donor splicing site and 50 bp downstream genomic sequence of a donor splicing site, and (5) an acceptor genomic template comprising 50 bp upstream genomic sequence of an acceptor splicing site and 50 bp downstream genomic sequence of an acceptor splicing site. The first set of templates is used to filter false positives and provide accurate read alignment information. A candidate gene fusion is removed if any of the first template set sequences are identical, but map to different genes in the human genome. Next, a second set of templates is created. The second set of templates comprises (a) a fusion template comprising 150 bp of exonic sequence of a preserved region of a donor gene and 150 bp of exonic sequence of a preserved region of an acceptor gene, (b) a donor template comprising 150 bp of exonic sequence of a preserved region of a donor gene and 150 bp of exonic sequence of a discarded region of an donor gene, (c) an acceptor template comprising 150 bp of exonic sequence of a discarded region of a acceptor gene and 150 bp of exonic sequence of a preserved region of an acceptor gene, (d) a donor genomic template comprising 150 bp upstream genomic sequence of a donor splicing site and 150 bp downstream genomic sequence of a donor splicing site, and (e) an acceptor genomic template comprising 150 bp upstream genomic sequence of an acceptor splicing site and 150 bp downstream genomic sequence of an acceptor splicing site. The second set of templates is also used to filter false positives by determining the homology between templates (b) and (c) and between templates (d) and (e) and removing the candidate gene fusion if templates (b) and (c) are homologous or if templates (d) and (e) are homologous. Next, a read obtained from RNA sequencing of the biological sample is aligned to the first set of templates and the read that maps to the fusion template of the first set of templates is selected.

In some embodiments, a gene fusion is identified by a candidate gene fusion having at least two non-duplicate reads that map to the fusion template of the first set of templates.

In other embodiments, a gene fusion is identified by a candidate gene fusion having one non-duplicate read that maps to the fusion template of the first set of templates. The method then comprises determining and comparing the expression levels of the exons and introns of the preserved regions of the donor gene and the acceptor gene to the expression levels of the exons and introns of the discarded regions of the donor gene and the acceptor gene. A gene fusion is then identified as having increased expression levels of exons and introns of the preserved regions of the donor gene and the acceptor gene compared to the expression levels of the exons and introns of the discarded regions of the donor gene and the acceptor gene.

In another aspect, the present invention provides a method for predicting the presence of a gene fusion in a biological sample obtained from a patient with cancer. The method comprises identifying a gene fusion according to any of claims 1-3 in a first biological sample. Next, a second biological sample that does not have reads that map to the gene fusion is obtained. Then, the method comprises determining in the second biological sample the expression levels of exons and introns of preserved and discarded regions of a donor gene and an acceptor gene of the gene fusion identified in any of claims 1-3. The expression level of the second biological sample is compared to the expression levels of the first biological sample. The presence of the gene fusion in the second biological sample is predicted based on having a similar expression profile compared to the first biological sample.

In yet another aspect, the invention provides a method of predicting a likelihood of poor prognosis in a breast cancer patient. Gene fusion events in a breast tumor sample from the patient are identified and the number of gene fusion events in the breast tumor sample is determined. The presence of three or more gene fusion events is positively correlated with an increased likelihood of poor prognosis.

In a further aspect, the present invention provides a method of identifying an alternatively spliced junction in a biological sample obtained from a patient with cancer. The method comprises obtaining a read from RNA sequencing of the biological sample. Next, the read is mapped to the human genome. It is then determined whether the read comprises a distant spliced junction and the read that comprises the distant spliced junction is selected. It is next determined whether the distant spliced junction is present in a single gene. The distant spliced junction that is present in a single gene is selected. In some embodiments, the method further comprises preparing a report based on the identification of an alternative spliced junction.

In still a further aspect, the present invention provides a method for predicting a risk of recurrence of breast cancer. The method comprises determining the presence of an alternative spliced junction in a breast cancer tumor sample obtained from said patient. The alternative spliced junction is selected from Table 5. The presence of junction –chr3:196118684_–chr3:196129890 in UBXN, junction –chr12:24366277_–chr12:24048958 in SOX5, junction –chr9:114148657_–chr9:114154104 in KIAA0368, junction +chr18:39629569_+chr18:39623697 in PIK3C3, or junction+chr1:155695810_chr1:155695173 is correlated with an decreased risk of recurrence, and wherein the presence of junction –chr2:99786013_–chr2:99787892 in MITD1 is correlated with an increased risk of recurrence. The presence of the alternative spliced junction can be determined by whole transcriptome sequencing or reverse transcriptase polymerase chain reaction (RT-PCR).

In some embodiments, an isolated polynucleotide comprises a gene fusion, wherein the isolated polynucleotide comprises a sequence selected from SEQ ID NO:1 to SEQ ID NO:100 is provided In other embodiments, an isolated polynucleotide comprises an alternative spliced junction selected from –chr12:24366277_–chr12:24048958; –chr9:114148657_–chr9:114154104; +chr18:39629569_+chr18:39623697; +chr1:155695810_chr1:155695173; and –chr2:99786013_–chr2:99787892 is provided.

BRIEF DESCRIPTION OF THE DRAWINGS

FIG. 2 also provides the equation used to calculate the interrupt ratio (IR).

FIG. 3 (FIG. 3.1-FIG. 3.105) shows the sequences of the 100 bp five template set (fusion template, donor template, acceptor template, donor genomic template, and acceptor genomic template) and any supporting reads for the gene fusion candidates identified using the bioinformatics approach. Sample information appears below the corresponding sequence information. FIG. 3 discloses SEQ ID NOS 358-3278, respectively, in order of appearance.

FIG. 4 (FIG. 4.1-FIG. 4.105) shows exon and intron expression data from the candidate gene fusions. The identifiers beginning with "X" represent patient samples identified to be positive for the indicated fusion. For example, in FIG. 4.1, patient sample X111TTAGGC_7 was identified as positive for the ACACA_MSI2 fusion.

The top panel shows a scatter plot of the expression data. The x-axis shows the number of normalized counts for the indicated fusion donor and the y-axis shows the number of normalized counts for the indicated fusion acceptor. The closed circles represent samples that are positive for the indicated fusion and the open circles shows the remaining samples in the cohort that are negative for the fusion.

The middle panel shows a bar plot of the expression of the exons and introns of the indicated fusion donor. The x-axis shows the relative genomic location of the donor's exons and introns and the y-axis shows the number of normalized counts by length. The vertical line separates the donor exons and introns into those that preserved in the fusion (black bars) and those that are discarded from the fusion (gray bars). As shown on the x-axis, the symbol "d" indicates that the exon or intron is a donor exon or intron; the symbol "l" indicates that the exon or intron is located to the left of the vertical line separating discarded and preserved exons and introns; the symbol "r" indicates that the exon or intron is located to the right of the vertical line separating discarded and preserved exons and introns.

The bottom panel shows a bar plot of the expression of the exons and introns of the indicated fusion acceptor. The x-axis shows the relative genomic location of the acceptor's exons and introns and the y-axis shows the number of normalized counts by length. The vertical line separates the acceptor exons and introns into those that preserved in the fusion (black bars) and those that are discarded from the fusion (gray bars). As shown on the x-axis, the symbol "a" indicates that the exon or intron is an acceptor exon or intron; the symbol "l" indicates that the exon or intron is located to the left of the vertical line separating discarded and preserved exons and introns; the symbol "r" indicates that the exon or intron is located to the right of the vertical line separating discarded and preserved exons and introns.

FIG. 5A shows the distributions of block age, cancer relapse and ER status according to fusion number categories in Providence and Rush cohorts. The archived block age was plotted as mean and standard deviation for each category. ER status was assessed by immunohistochemistry. The patient number for each category was labeled accordingly.

FIG. 5B shows Kaplan-Meier plots of each fusion number category demonstrating patients with multiple fusions had poor prognosis in Providence, and a similar trend existed in Rush. The log-rank p-values were indicated in Kaplan-Meier plots.

Figure 5C:
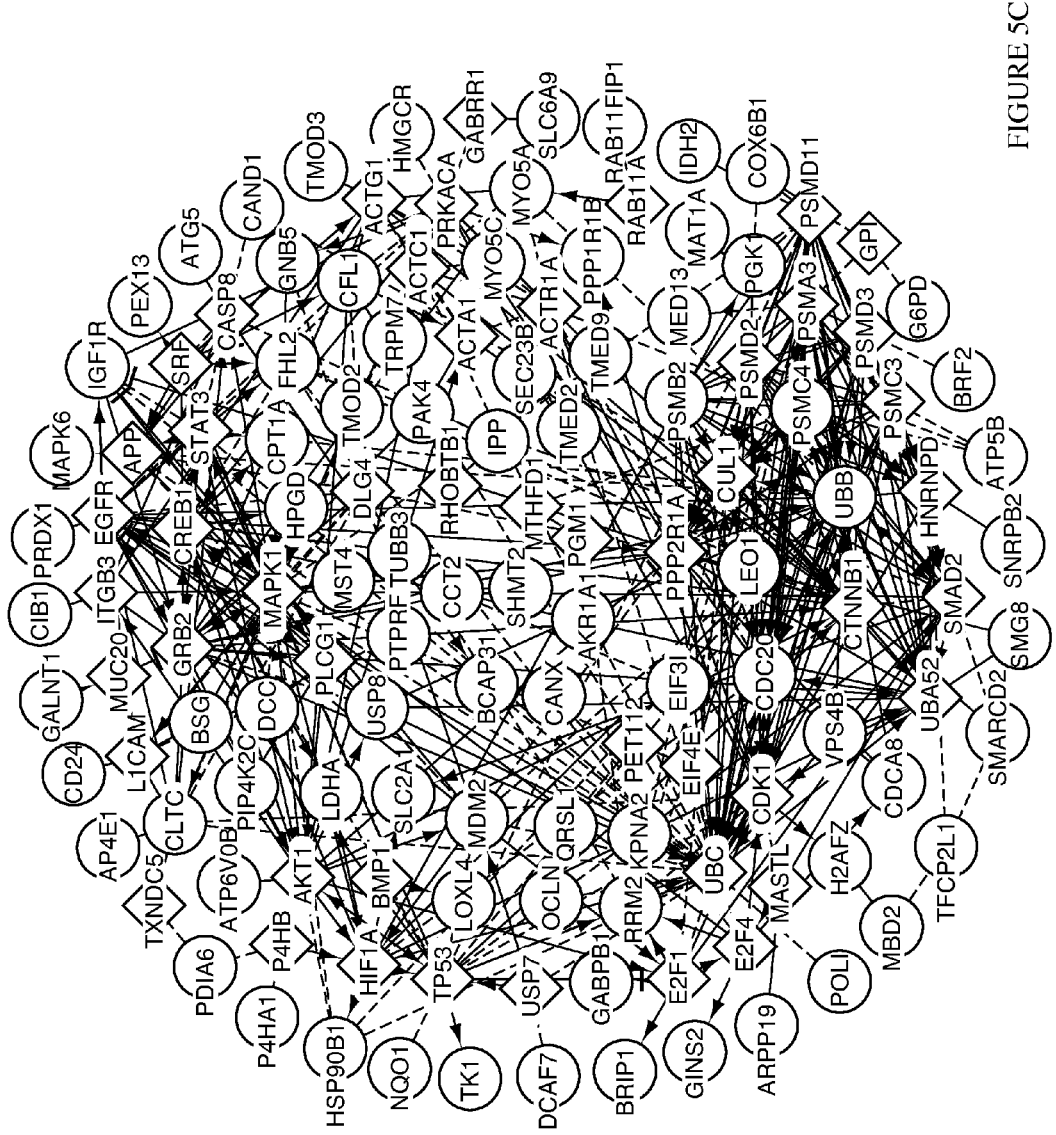

FIG. 5C shows that the differentially expressed genes between multiple fusion samples versus no fusion samples in Providence were mapped to the Reactome FI database and clustered into five core sub-modules via linker proteins (in grey shaded rectangles) by the Reactome FI Cytoscape Plugin. The connected 84 genes are referred as the fusion gene signature. Nodes were manually arranged to display the sub-modules properly. Edges displayed FI direction attribute values as the following, "→" for activating/catalyzing, "-|" for inhibition, "-" for FIs extracted from complexes or inputs, and "---" for predicted FIs.

FIG. 5D shows fusion signature indexes plotted for each of the fusion number categories in Providence and Rush. The fusion signature index is the average expression levels of 84 fusion gene signatures as shown in FIG. 5C. The base counts of each signature gene were normalized by library size then scaled across the patient cohort before averaged in the signature index. The p-values were derived from Wilcoxon tests.

FIG. 6 depicts Kaplan-Meier plots of patient subsets of Providence or Rush patients as a function of fusion numbers, segregated by block age. Either upper three quantiles or lower three quantiles based on block age were selected to examine the effect of the block ages on the disease outcome. The log-rank p-values are displayed.

FIG. 7 depicts Venn diagrams between differentially expressed genes from samples segregated by fusion numbers and ER status in Providence. The additive model of edgeR was used only for DE analysis between multiple fusion samples versus no fusion samples. The up-regulated and down-regulated gene numbers were labeled with each differential expression analysis. The overlapped gene numbers combined from both up-regulated and down-regulated genes were labeled according to each comparison. A. ER$^+$ samples contribute to fusion gene signatures more than ER$^-$ samples in Providence, consistent with the expression evidence from heatmaps. The overlapping genes between fusion gene signatures and differentially expressed genes due to ER status difference in both multiple fusion and no fusion groups are small.

Figure 8:
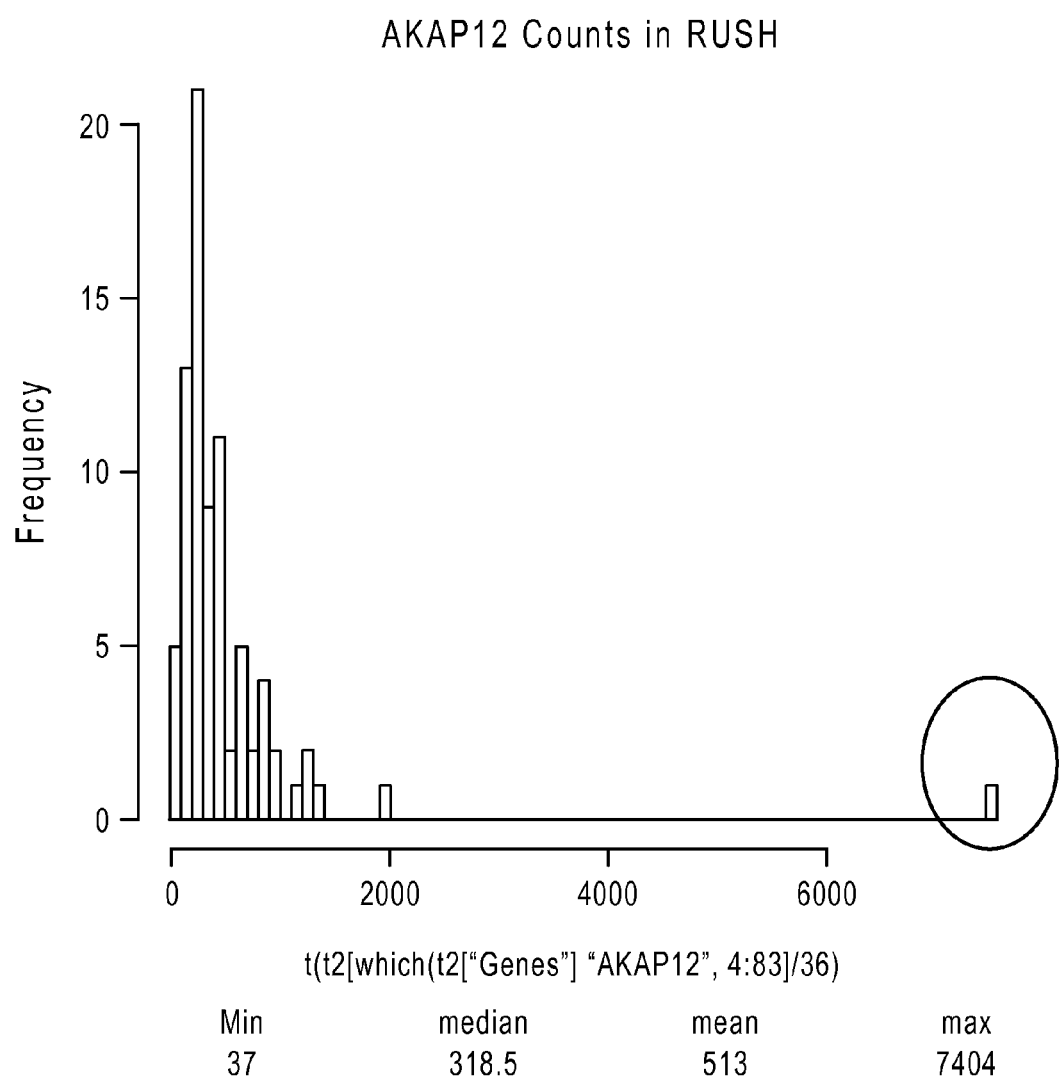

FIG. 8 shows the expression level of AKAP12 in patients of the Rush cohort.

FIG. 9 shows Protein domains of fusion ESR1→AKAP12 are illustrated based on UniProt database (www.uniprot.org). The red vertical line indicates the fusion position on the corresponding protein. The amino acid length and amino acid positions of each fusion position are labeled on the top of each protein. A. The protein domains of ESR1 protein P03372. B. The protein domains of AKAP12 protein Q02952. C. The protein domains of two predicted fusion proteins ESR1→AKAP12. The one amino acid insertion generated from the fusion event is labeled on each fusion protein.

DETAILED DESCRIPTION

Before the present invention and specific exemplary embodiments of the invention are described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range is encompassed within the invention. The upper and lower limits of these smaller ranges may independently be included in the smaller ranges is also encompassed within the invention, subject to any specifically excluded limit in the stated range. Where the stated range includes one or both of the limits, ranges excluding either both of those included limits are also included in the invention.

As used herein and in the appended claims, the singular forms "a," "an," and "the" include plural referents unless the context clearly dictates otherwise. Thus, for example, reference to "an RNA transcript" includes a plurality of such RNA transcripts.

Unless defined otherwise, technical and scientific terms used herein have the same meaning as commonly understood by one of ordinary skill in the art to which this invention belongs. For example, Singleton et al., Dictionary of Microbiology and Molecular Biology 2nd ed., J. Wiley & Sons (New York, N.Y. 1994), provide one skilled in the art with a general guide to many of the terms used in the present application.

Additionally, the practice of the present invention will employ, unless otherwise indicated, conventional techniques of molecular biology (including recombinant techniques), microbiology, cell biology, and biochemistry, which are within the skill of the art. Such techniques are explained fully in the literature, such as, "Molecular Cloning: A Laboratory Manual", $2^{nd}$ edition (Sambrook et al., 1989); "Oligonucleotide Synthesis" (M. J. Gait, ed., 1984); "Animal Cell Culture" (R. I. Freshney, ed., 1987); "Methods in Enzymology" (Academic Press, Inc.); "Handbook of Experimental Immunology", $4^{th}$ edition (D. M. Weir & C. C. Blackwell, eds., Blackwell Science Inc., 1987); "Gene Transfer Vectors for Mammalian Cells" (J. M. Miller & M. P. Calos, eds., 1987); "Current Protocols in Molecular Biology" (F. M. Ausubel et al., eds., 1987); and "PCR: The Polymerase Chain Reaction", (Mullis et al., eds., 1994).

One skilled in the art will recognize many methods and materials similar or equivalent to those described herein, which could be used in the practice of the present invention. Indeed, the present invention is in no way limited to the methods and materials described. For purposes of the present invention, the following terms are defined below.

The term "annotate" refers to adding biological information to a genome sequence.

The terms "cancer" and "cancerous" refer to or describe the physiological condition in mammals that is typically characterized by unregulated cell growth. Examples of cancer include but are not limited to, breast cancer, colon cancer, lung cancer, prostate cancer, hepatocellular cancer, gastric cancer, pancreatic cancer, cervical cancer, ovarian cancer, liver cancer, bladder cancer, cancer of the urinary tract, thyroid cancer, renal cancer, carcinoma, melanoma, and brain cancer.

The term "correlates" or "correlating" as used herein refers to a statistical association between instances of two events, where events may include numbers, data sets, and the like. For example, when the events involve numbers, a positive correlation (also referred to herein as a "direct correlation") means that as one increases, the other increases as well. A negative correlation (also referred to herein as an "inverse correlation") means that as one increases, the other decreases. The present invention provides gene fusions and alternative spliced junctions which may be correlated with a particular outcome measure. For example, the presence of a gene fusion or an alternative spliced junction may be positively correlated with a likelihood of a good clinical outcome for the patient, such as an increased likelihood of long-term survival without recurrence and/or a positive response to a chemotherapy, and the like. Such a positive correlation may be demonstrated statistically in various ways, e.g. by a low hazard ratio. In another example, the presence of a gene fusion or an alternative spliced junction may be negatively correlated with a likelihood of good clinical outcome for the patient. In this case, for example, the patient may have a decreased likelihood of long-term survival without recurrence of the cancer and/or a positive response to a chemotherapy, and the like. Such a negative correlation indicates that the patient likely has a poor prognosis or will respond poorly to a chemotherapy, and this may be demonstrated statistically in various ways, e.g., by a high hazard ratio.

As used herein, the term "exon" refers to any segment of an interrupted gene that is represented in the mature RNA product (B. Lewin. Genes IV Cell Press, Cambridge Mass. 1990). As used herein, the terms "intron" and "intronic sequence" refer to any non-coding region found within genes.

The term "expression product" as used herein refers to an expression product of a coding RNA transcript. Thus, the term refers to a polypeptide or protein.

As used herein, the term "intergenic region" refers to a stretch of DNA or RNA sequences located between clusters of genes that contain few or no genes. Intergenic regions are different from intragenic regions (or "introns"), which are non-coding regions that are found between exons within genes. An intergenic region may be comprised of one or more "intergenic sequences."

As used herein, the term "gene fusion" refers to a chimeric molecule derived from two separate genes—a donor gene and an acceptor gene. The donor gene is generally located upstream of the acceptor gene. The regions of the donor gene and the acceptor gene that are present in the gene fusion are referred to herein as a "preserved region" of the donor gene and a "preserved region" of the acceptor gene, respectively. The regions of the donor gene and the acceptor gene that are not present in the gene fusion are referred to herein as a "discarded region" of the donor gene and a "discarded region" of the acceptor gene, respectively. A gene fusion may arise from a chromosomal aberration, such as a translocation, deletion, or inversion, within a chromosome or between chromosomes. A gene fusion may result in an expression product with a new or different function compared to the fusion partners. Alternatively, a proto-oncogene may be fused to a strong promoter, resulting in expression of an oncogene. A gene fusion is recurrent when it is present in samples from two or more patients with the same type of cancer, for example, breast cancer.

As used herein, the term "homology" with regard to template sequences, refers to the degree of similarity between two sequences. In some embodiments, a 300 bp donor template and a 300 bp acceptor template are homologous if they share sequence identity of more than 14 bp. In other embodiments, a 300 bp donor genomic template and a 300 bp acceptor genomic template are homologous if they share sequence identity of more than 14 bp.

As used herein, the term "isolated" refers to a molecule that is separated from other constituents. For example, an isolated DNA molecule may be cleaved from genomic DNA or synthesized to include a portion of a naturally occurring DNA molecule. Isolated DNA is a free-standing portion of the larger, natural DNA molecule. Isolated DNA molecules, therefore, are not naturally occurring DNA molecules or native DNA molecules.

As used herein, the term "level" refers to qualitative or quantitative determination of the number of reads of exons and introns in the genes that comprise a gene fusion. An exon or an intron exhibits an "increased level" when the level of the exon or intron is higher in a first sample, such as in a preserved acceptor or donor region of a gene fusion, than in a second sample, such as in a discarded acceptor or donor region of a gene fusion.

The term "long-term" survival as used herein refers to survival for at least 3 years. In other embodiments, it may refer to survival for at least 5 years, or for at least 10 years following surgery or other treatment.

As used herein, the term "pathology" of cancer includes all phenomena that comprise the well-being of the patient. This includes, without limitation, abnormal or uncontrollable cell growth, metastasis, interference with the normal functioning of neighboring cells, release of cytokines or other secretory products at abnormal levels, suppression or aggravation of inflammatory or immunological response, neoplasia, premalignancy, malignancy, invasion of surrounding or distant tissues or organs, such as lymph nodes.

A "patient response" may be assessed using any endpoint indicating a benefit to the patient, including, without limitation, (1) inhibition, to some extent, of tumor growth, including slowing down and complete growth arrest; (2) reduction in the number of tumor cells; (3) reduction in tumor size; (4) inhibition (i.e., reduction, slowing down or complete stopping) of tumor cell infiltration into adjacent peripheral organs and/or tissues; (5) inhibition (i.e. reduction, slowing down or complete stopping) of metastasis; (6) enhancement of anti-tumor immune response, which may, but does not have to, result in the regression or rejection of the tumor; (7) relief, to some extent, of one or more symptoms associated with the cancer; (8) increase in the length of survival following treatment; and/or (9) decreased mortality at a given point of time following treatment.

The term "polynucleotide" when used in singular or plural, generally refers to any polyribonucleotide or polydeoxribonucleotide, which may be unmodified RNA or DNA or modified RNA or DNA. Thus, for instance, polynucleotides as defined herein include, without limitation, single- and double-stranded DNA, DNA including single- and double-stranded regions, single- and double-stranded RNA, and RNA including single- and double-stranded regions, hybrid molecules comprising DNA and RNA that may be single-stranded or, more typically, double-stranded or include single- and double-stranded regions. In addition, the term "polynucleotide" as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. The term "polynucleotide" specifically includes cDNAs. The term includes DNAs (including cDNAs) and RNAs that contain one or more modified bases. Thus, DNAs or RNAs with backbones modified for stability or for other reasons are "polynucleotides" as that term is intended herein. Moreover, DNAs or RNAs comprising unusual bases, such as inosine, or modified bases, such as tritiated bases, are included within the term "polynucleotides" as defined herein. In general, the term "polynucleotide" embraces all chemically, enzymatically and/or metabolically modified forms of unmodified polynucleotides, as well as the chemical forms of DNA and RNA characteristic of viruses and cells, including simple and complex cells.

The term "prognosis" as used herein, refers to the prediction of the likelihood of cancer-attributable death or progression, including recurrence, metastatic spread, and drug resistance, of neoplastic disease, such as breast cancer. The term "prediction" is used herein to refer to the likelihood that a patient will respond either favorably or unfavorably to a drug or set of drugs, and also the extent of those responses, or that a patient will survive, following surgical removal of the primary tumor and/or chemotherapy for a certain period of time without cancer recurrence. The methods of the present invention can be used clinically to make treatment decisions by choosing the most appropriate treatment modalities for any particular patient. The methods of the present invention are tools in predicting if a patient is likely to respond favorably to a treatment regimen, such as surgical intervention, chemotherapy with a given drug or drug combination, and/or radiation therapy, or whether long-term survival of the patient without cancer recurrence is likely, following surgery and/or termination of chemotherapy or other treatment modalities.

The term "recurrence," as used herein, refers to local or distant (metastasis) recurrence of cancer. For example, breast cancer can come back as a local recurrence (in the treated breast or near the tumor surgical site) or as a distant recurrence in the body. The most common sites of breast cancer recurrence include the lymph nodes, bones, liver, or lungs.

As used herein, the term "RefSeq RNA" refers to an RNA that can be found in the Reference Sequence (RefSeq) database, a collection of publicly available nucleotide sequences and their protein products built by the National Center for Biotechnology Information (NCBI). The RefSeq database provides an annotated, non-redundant record for each natural biological molecule (i.e. DNA, RNA or protein) included in the database. Thus, a sequence of a RefSeq RNA is well-known and can be found in the RefSeq database at http://www.ncbi.nlm.nih.gov/RefSeq/. See also Pruitt et al., *Nucl. Acids Res.* 33(Supp 1):D501-D504 (2005). Accession numbers for donor and acceptor RefSeq are provided in Table A.

As used herein, the term "RNA transcript" refers to the RNA transcription product of DNA and includes coding and non-coding RNA transcripts. RNA transcripts include, for example, mRNA, an unspliced RNA, a splice variant mRNA, a microRNA, fragmented RNA, long intergenic non-coding RNAs (lincRNAs), intergenic RNA sequences or regions, and intronic RNAs.

The terms "read" and "sequence read" are used interchangeably herein to refer to sequence information obtained from an RNA sequencing experiment. A read may comprise, for example, 50 bases to 150 bases, 50 bases to 100 bases, 50 bases to 55 bases, 55 bases to 60 bases, 60 bases to 65 bases, 65 bases to 70 bases, 70 bases to 75 bases, 75 bases to 80 bases, 80 bases to 85 bases, 85 bases to 90 bases, 90 bases to 95 bases, 95 bases to 100 bases, 100 bases to 105, 105 bases to 110, 110 bases to 115, 115 bases to 120, 120 bases to 125, 125 bases to 130, 130 bases to 135, 135 bases to 140, 140 bases to 145, or 145 bases to 150 bases. A read may be a single read or a paired-end read. A single read refers to a read that is sequenced from one end. A paired-end read refers to a read that is sequenced from both ends.

As used herein, the term "splicing" refers to the process of removing introns and joining exons from pre-mRNA to generate mRNA. The terms "splice site" and "splice junction" are used interchangeably to refer to a region where a splicing event takes place, for example, at an exon-intron junction in a pre-mRNA molecule. For example, a slice donor site may be present at the 5' end of an intron and a splice acceptor site may be present at the 3' end of an intron. As used herein, a "distant spliced site" includes sites used in splicing events that occur between different genes or chromosomes. Distant splicing events may also include splicing events occurring within the same gene, but in the opposite transcription direction. Distant splicing events may include translocations, inversions, and the like. As used herein, "alternative splicing" refers to a process whereby identical pre-mRNA molecules are spliced in various ways to yield different mRNA molecules. The different mRNA molecules may be translated into different protein isoforms.

In some embodiments, the alternative spliced junction is present UBXN7, SOX5, KIAA0368, PIKC3C, DAP3, or MITD1. In other embodiments, the alternative spliced junction within UBXN7 comprises the junction −chr3:196118684_−chr3:196129890; the alternative spliced junction within SOX5 comprises the junction −chr12:24366277_−chr12:24048958; the alternative spliced junction within KIAA0368 comprises the junction −chr9:114148657_−chr9:114154104; the alternative spliced junction within PIK3C3 comprises the junction+chr18:39629569_+chr18:39623697; the alternative spliced junction within DAP3 comprises the junction+chr1:155695810_chr1:155695173; and the alternative spliced junction within MITD1 comprises the junction −chr2:99786013_−chr2:99787892.

The terms "subject," "individual," and "patient" are used interchangeably herein to refer to a mammal being assessed for treatment and/or being treated. In an embodiment, the mammal is a human. The terms "subject," "individual," and "patient" thus encompass individuals having cancer (e.g., breast cancer), including those who have undergone or are candidates for resection (surgery) to remove cancerous tissue.

As used herein, the term "surgery" applies to surgical methods undertaken for removal of cancerous tissue, including mastectomy, lumpectomy, lymph node removal, sentinel lymph node dissection, prophylactic mastectomy, prophylactic ovary removal, cryotherapy, and tumor biopsy. The tumor samples used for the methods of the present invention may have been obtained from any of these methods.

As used herein, the term "template" refers to a nucleotide sequence against which another nucleotide sequence may be compared. The templates used in the methods of the present invention include (1) a fusion template comprising 50 or 150 bp of exonic sequence of a preserved region of a donor gene and 50 or 150 bp of exonic sequence of a preserved region of an acceptor gene, (2) a donor template comprising 50 or 150 bp of exonic sequence of a preserved region of a donor gene and 50 or 150 bp of exonic sequence of a discarded region of an donor gene, (3) an acceptor template comprising 50 or 150 bp of exonic sequence of a discarded region of a acceptor gene and 50 or 150 bp of exonic sequence of a preserved region of an acceptor gene, (4) a donor genomic template comprising 50 or 150 bp upstream genomic sequence of a donor splicing site and 50 or 150 bp downstream genomic sequence of a donor splicing site, and (5) an acceptor genomic template comprising 50 or 150 bp upstream genomic sequence of an acceptor splicing site and 50 or 150 bp downstream genomic sequence of an acceptor splicing site. In some embodiments, the method comprises determining the homology between various templates. In other embodiments, the method comprises aligning a read obtained from RNA sequencing of a biological sample to the templates and selecting the read that maps to the fusion template.

The term "tumor" as used herein, refers to all neoplastic cell growth and proliferation, whether malignant or benign, and all pre-cancerous and cancerous cells and tissues.

The term "tumor sample" as used herein refers to a sample comprising tumor material obtained from a cancer patient. The term encompasses tumor tissue samples, for example, tissue obtained by surgical resection and tissue obtained by biopsy, such as for example, a core biopsy or a fine needle biopsy. In a particular embodiment, the tumor sample is a fixed, wax-embedded tissue sample, such as a formalin-fixed, paraffin-embedded tissue sample. Additionally, the term "tumor sample" encompasses a sample comprising tumor cells obtained from sites other than the primary tumor, e.g., circulating tumor cells. The term also encompasses cells that are the progeny of the patient's tumor cells, e.g. cell culture samples derived from primary tumor cells or circulating tumor cells. The term further encompasses samples that may comprise protein or nucleic acid material shed from tumor cells in vivo, e.g., bone marrow, blood, plasma, serum, and the like. The term also encompasses samples that have been enriched for tumor cells or otherwise manipulated after their procurement and samples comprising polynucleotides and/or polypeptides that are obtained from a patient's tumor material.

As used herein, "whole transcriptome sequencing" refers to the use of high throughput sequencing technologies to sequence the entire transcriptome in order to get information about a sample's RNA content. Whole transcriptome sequencing can be done with a variety of platforms for example, the Genome Analyzer or HiSeq 2000/2500 (Illumina, Inc., San Diego, Calif.) and the SOLiD™ Sequencing System (Life Technologies, Carlsbad, Calif.). However, any platform useful for whole transcriptome sequencing may be used.

The term "RNA-Seq" or "transcriptome sequencing" or "RNA sequencing" refers to sequencing performed on RNA (or cDNA) instead of DNA, where typically, the primary goal is to measure expression levels, detect fusion transcripts, alternative splicing, and other genomic alterations that can be better assessed from RNA. RNA-Seq includes whole transcriptome sequencing as well as target specific sequencing.

The term "computer-based system," as used herein, refers to the hardware means, software means, and data storage means used to analyze information. The minimum hardware of a patient computer-based system comprises a central processing unit (CPU), input means, output means, and data storage means. A skilled artisan can readily appreciate that many of the currently available computer-based system are suitable for use in the present invention and may be programmed to perform the specific measurement and/or calculation functions of the present invention.

To "record" data, programming or other information on a computer readable medium refers to a process for storing information, using any such methods as known in the art. Any convenient data storage structure may be chosen, based on the means used to access the stored information. A variety of data processor programs and formats can be used for storage, e.g. word processing text file, database format, etc.

A "processor" or "computing means" references any hardware and/or software combination that will perform the functions required of it. For example, any processor herein may be a programmable digital microprocessor such as available in the form of an electronic controller, mainframe, server or personal computer (desktop or portable). Where the processor is programmable, suitable programming can be communicated from a remote location to the processor, or previously saved in a computer program product (such as a portable or fixed computer readable storage medium, whether magnetic, optical or solid state device based). For example, a magnetic medium or optical disk may carry the programming, and can be read by a suitable reader communicating with each processor at its corresponding station.

The present invention provides gene fusions and alternative spliced junctions that are associated with breast cancer.

These gene fusions are listed in Tables A and B and the alternative spliced junctions are provided in Table 5. The present invention also provides a method for identifying gene fusions and a method for identifying alternative spliced junctions in a biological sample obtained from a patient with cancer. The present invention further provides a method for predicting a gene fusion in a biological sample obtained from a patient with cancer.

The gene fusions and alternative spliced junctions and associated information provided by the present invention also have utility in the development of therapies to treat cancers and screening patients for inclusion in clinical trials. The gene fusions and alternative spliced junctions and associated information may further be used to design or produce a reagent that modulates the level or activity of the gene fusion and alternative spliced junction. Such reagents may include, but are not limited to, a drug, an antisense RNA, a small inhibitory RNA (siRNA), a ribozyme, a small molecule, a monoclonal antibody, and a polyclonal antibody.

In various embodiments of the methods of the present invention, various technological approaches are available for determining the presence of gene fusions or alternative spliced junctions, including, without limitation, whole transcriptome sequencing, RT-PCR, microarrays, and serial analysis of gene expression (SAGE), which are described in more detail below.

Correlating the Presence of a Gene Fusion or an Alternative Spliced Junction to a Clinical Outcome One skilled in the art will recognize that there are many statistical methods that may be used to determine whether there is a correlation between an outcome of interest (e.g., likelihood of survival) and the presence of a gene fusion or an alternative spliced junction. This relationship can be presented as a continuous recurrence score (RS), or patients may be stratified into risk groups (e.g., low, intermediate, high). For example, a Cox proportional hazards regression model may fit to a particular clinical endpoint (e.g., RFI, DFS, OS). One assumption of the Cox proportional hazards regression model is the proportional hazards assumption, i.e. the assumption that effect parameters multiply the underlying hazard. Assessments of model adequacy may be performed including, but not limited to, examination of the cumulative sum of martingale residuals. One skilled in the art would recognize that there are numerous statistical methods that may be used (e.g., Royston and Parmer (2002), smoothing spline, etc.) to fit a flexible parametric model using the hazard scale and the Weibull distribution with natural spline smoothing of the log cumulative hazards function, with effects for treatment (chemotherapy or observation) and RS allowed to be time-dependent. (See, e.g., P. Royston, M. Parmer, Statistics in Medicine 21(15:2175-2197 (2002).)

In an exemplary embodiment, power calculations are carried out for the Cox proportional hazards model with a single non-binary covariate using the method proposed by F. Hsieh and P. Lavori, Control Clin Trials 21:552-560 (2000) as implemented in PASS 2008.

Methods of Assaying Gene Fusions and Alternative Spliced Junctions

Methods of assaying gene fusions and alternative spliced junctions include methods based on sequencing of polynucleotides, methods based on hybridization analysis of polynucleotides, and proteomics-based methods. Representative methods for sequencing-based analysis include Massively Parallel Sequencing (see e.g., Tucker et al., The American J. Human Genetics 85:142-154, 2009) and Serial Analysis of Gene Expression (SAGE). Exemplary methods known in the art for the quantification of mRNA expression in a sample include northern blotting and in situ hybridization (Parker & Barnes, Methods in Molecular Biology 106:247-283 (1999)); RNAse protection assays (Hod, Biotechniques 13:852-854 (1992)); and PCR-based methods, such as reverse transcription polymerase chain reaction (RT-PCR) (Weis et al., Trends in Genetics 8:263-264 (1992)). Antibodies may be employed that can recognize sequence-specific duplexes, including DNA duplexes, RNA duplexes, and DNA-RNA hybrid duplexes or DNA-protein duplexes.

Nucleic Acid Sequencing-Based Methods

Nucleic acid sequencing technologies are suitable methods for expression analysis. The principle underlying these methods is that the number of times a cDNA sequence is detected in a sample is directly related to the relative RNA levels corresponding to that sequence. These methods are sometimes referred to by the term Digital Gene Expression (DGE) to reflect the discrete numeric property of the resulting data. Early methods applying this principle were Serial Analysis of Gene Expression (SAGE) and Massively Parallel Signature Sequencing (MPSS). See, e.g., S. Brenner, et al., Nature Biotechnology 18(6):630-634 (2000).

More recently, the advent of "next-generation" sequencing technologies has made DGE simpler, higher throughput, and more affordable. As a result, more laboratories are able to utilize DGE to screen the expression of more nucleic acids in more individual patient samples than previously possible. See, e.g., J. Marioni, Genome Research 18(9):1509-1517 (2008); R. Morin, Genome Research 18(4):610-621 (2008); A. Mortazavi, Nature Methods 5(7):621-628 (2008); N. Cloonan, Nature Methods 5(7):613-619 (2008). Massively parallel sequencing methods have also enabled whole genome or transcriptome sequencing, allowing the analysis of not only coding but also non-coding sequencees. As reviewed in Tucker et al., The American J. Human Genetics 85:142-154 (2009), there are several commercially available massively parallel sequencing platforms, such as the Illumina Genome Analyzer or HiSeq 2000/2500 (Illumina, Inc., San Diego, Calif.), Applied Biosystems SOLiD™ Sequencer (Life Technologies, Carlsbad, Calif.), Roche GS-FLX 454 Genome Sequencer (Roche Applied Science, Germany), and the Helicos® Genetic Analysis Platform (Helicos Biosciences Corp., Cambridge, Mass.). Other developing technologies may be used.

Reverse Transcriptase PCR (RT-PCR)

The starting material is typically total RNA isolated from a human tumor, usually from a primary tumor. Optionally, normal tissues from the same patient can be used as an internal control. RNA can be extracted from a tissue sample, e.g., from a sample that is fresh, frozen (e.g. fresh frozen), or fixed and paraffin-embedded (e.g. formalin-fixed).

General methods for RNA extraction are well known in the art and are disclosed in standard textbooks of molecular biology, including Ausubel et al., Current Protocols of Molecular Biology, John Wiley and Sons (1997). Methods for RNA extraction from paraffin embedded tissues are disclosed, for example, in Rupp and Locker, Lab Invest. 56:A67 (1987), and De Andrés et al., BioTechniques 18:42044 (1995). In particular, RNA isolation can be performed using a purification kit, buffer set and protease from commercial manufacturers, such as Qiagen, according to the manufacturer's instructions. For example, total RNA from cells in culture can be isolated using Qiagen RNeasy mini-columns. Other commercially available RNA isolation kits include MasterPure™ Complete DNA and RNA Purification Kit (EPICENTRE®, Madison, Wis.), and Paraffin Block RNA Isolation Kit (Ambion, Inc.). Total RNA from fresh frozen tissue samples can be isolated using RNA Stat-60 (Tel-Test). RNA prepared from a tumor sample can be isolated, for example, by cesium chloride density gradient centrifugation. The isolated RNA may then be depleted of ribosomal RNA as described in U.S. Pub. No. 2011/0111409.

The sample containing the RNA is then subjected to reverse transcription to produce cDNA from the RNA template, followed by exponential amplification in a PCR reaction. The two most commonly used reverse transcriptases are avian myeloblastosis virus reverse transcriptase (AMV-RT) and Moloney murine leukemia virus reverse transcriptase (MMLV-RT). The reverse transcription step is typically primed using specific primers, random hexamers, or oligo-dT primers, depending on the circumstances and the goal of the assay. For example, extracted RNA can be reverse-transcribed using a GeneAmp RNA PCR kit (Perkin Elmer, CA, USA), following the manufacturer's instructions. The derived cDNA can then be used as a template in the subsequent PCR reaction.

PCR-based methods use a thermostable DNA-dependent DNA polymerase, such as a Taq DNA polymerase. For example, TaqMan® PCR typically utilizes the 5'-nuclease activity of Taq or Tth polymerase to hydrolyze a hybridization probe bound to its target amplicon, but any enzyme with equivalent 5' nuclease activity can be used. Two oligonucleotide primers are used to generate an amplicon typical of a PCR reaction product. A third oligonucleotide, or probe, can be designed to facilitate detection of a nucleotide sequence of the amplicon located between the hybridization sites of the two PCR primers. The probe can be detectably labeled, e.g., with a reporter dye, and can further be provided with both a fluorescent dye, and a quencher fluorescent dye, as in a TaqMan® probe configuration. Where a TaqMan® probe is used, during the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

TaqMan® RT-PCR can be performed using commercially available equipment, such as, for example, ABI PRISM 7900™ Sequence Detection System™ (Perkin-Elmer-Applied Biosystems, Foster City, Calif., USA), or Lightcycler (Roche Molecular Biochemicals, Mannheim, Germany). In a preferred embodiment, the 5' nuclease procedure is run on a real-time quantitative PCR device such as the ABI PRISM 7900™ Sequence Detection System™. The system consists of a thermocycler, laser, charge-coupled device (CCD), camera and computer. The system amplifies samples in a 384-well format on a thermocycler. The RT-PCR may be performed in triplicate wells with an equivalent of 2 ng RNA input per 10 μL-reaction volume. During amplification, laser-induced fluorescent signal is collected in real-time through fiber optics cables for all wells, and detected at the CCD. The system includes software for running the instrument and for analyzing the data.

5'-Nuclease assay data are generally initially expressed as a threshold cycle ("$C_t$"). Fluorescence values are recorded during every cycle and represent the amount of product amplified to that point in the amplification reaction. The threshold cycle ($C_t$) is generally described as the point when the fluorescent signal is first recorded as statistically significant.

To minimize errors and the effect of sample-to-sample variation, RT-PCR is usually performed using an internal standard. The ideal internal standard gene (also referred to as a reference gene) is expressed at a constant level among cancerous and non-cancerous tissue of the same origin (i.e., a level that is not significantly different among normal and cancerous tissues), and is not significantly affected by the experimental treatment (i.e., does not exhibit a significant difference in expression level in the relevant tissue as a result of exposure to chemotherapy). RNAs most frequently used to normalize patterns of gene expression are mRNAs for the housekeeping genes glyceraldehyde-3-phosphate-dehydrogenase (GAPDH) and β-actin. Gene expression measurements can be normalized relative to the mean of one or more (e.g., 2, 3, 4, 5, or more) reference genes. Reference-normalized expression measurements can range from 0 to 15, where a one unit increase generally reflects a 2-fold increase in RNA quantity.

Real time PCR is compatible both with quantitative competitive PCR, where an internal competitor for each target sequence is used for normalization, and with quantitative comparative PCR using a normalization gene contained within the sample, or a housekeeping gene for RT-PCR. For further details see, e.g. Held et al., *Genome Research* 6:986-994 (1996).

Design of PCR Primers and Probes

PCR primers and probes can be designed based upon exon, intron, or intergenic sequences present in the RNA transcript of interest. Primer/probe design can be performed using publicly available software, such as the DNA BLAT software developed by Kent, W. J., *Genome Res.* 12(4):656-64 (2002), or by the BLAST software including its variations.

Where necessary or desired, repetitive sequences of the target sequence can be masked to mitigate non-specific signals. Exemplary tools to accomplish this include the Repeat Masker program available on-line through the Baylor College of Medicine, which screens DNA sequences against a library of repetitive elements and returns a query sequence in which the repetitive elements are masked. The masked sequences can then be used to design primer and probe sequences using any commercially or otherwise publicly available primer/probe design packages, such as Primer Express (Applied Biosystems); MGB assay-by-design (Applied Biosystems); Primer3 (Steve Rozen and Helen J. Skaletsky (2000) Primer3 on the WWW for general users and for biologist programmers. In: Rrawetz S, Misener S (eds) *Bioinformatics Methods and Protocols: Methods in Molecular Biology*. Humana Press, Totowa, N.J., pp 365-386).

Other factors that can influence PCR primer design include primer length, melting temperature (Tm), and G/C content, specificity, complementary primer sequences, and 3'-end sequence. In general, optimal PCR primers are generally 17-30 bases in length, and contain about 20-80%, such as, for example, about 50-60% G+C bases, and exhibit Tm's between 50 and 80° C., e.g. about 50 to 70° C.

For further guidelines for PCR primer and probe design see, e.g. Dieffenbach, C W. et al, "General Concepts for PCR Primer Design" in: *PCR Primer, A Laboratory Manual*, Cold Spring Harbor Laboratory Press, New York, 1995, pp. 133-155; Innis and Gelfand, "Optimization of PCRs" in: *PCR Protocols, A Guide to Methods and Applications*, CRC Press, London, 1994, pp. 5-11; and Plasterer, T. N. *Primerselect: Primer and probe design*. Methods Mol. Biol. 70:520-527 (1997), the entire disclosures of which are hereby expressly incorporated by reference.

MassARRAY® System

In MassARRAY-based methods, such as the exemplary method developed by Sequenom, Inc. (San Diego, Calif.) following the isolation of RNA and reverse transcription, the obtained cDNA is spiked with a synthetic DNA molecule (competitor), which matches the targeted cDNA region in all positions, except a single base, and serves as an internal standard. The cDNA/competitor mixture is PCR amplified and is subjected to a post-PCR shrimp alkaline phosphatase (SAP) enzyme treatment, which results in the dephosphorylation of the remaining nucleotides. After inactivation of the alkaline phosphatase, the PCR products from the competitor and cDNA are subjected to primer extension, which generates distinct mass signals for the competitor- and cDNA-derived PCR products. After purification, these products are dispensed on a chip array, which is pre-loaded with components needed for analysis with matrix-assisted laser desorption ionization time-of-flight mass spectrometry (MALDI-TOF MS) analysis. The cDNA present in the reaction is then quantified by analyzing the ratios of the peak areas in the mass spectrum generated. For further details see, e.g. Ding and Cantor, *Proc. Natl. Acad. Sci. USA* 100:3059-3064 (2003).

Other PCR-Based Methods

Further PCR-based techniques that can find use in the methods disclosed herein include, for example, BeadArray® technology (Illumina, San Diego, Calif.; Oliphant et al., *Discovery of Markers for Disease* (Supplement to Biotechniques), June 2002; Ferguson et al., *Analytical Chemistry* 72:5618 (2000)); BeadsArray for Detection of Gene Expression® (BADGE), using the commercially available LuminexlOO LabMAP® system and multiple color-coded microspheres (Luminex Corp., Austin, Tex.) in a rapid assay for gene expression (Yang et al., *Genome Res.* 11:1888-1898 (2001)); and high coverage expression profiling (HiCEP) analysis (Fukumura et al., *Nucl. Acids. Res.* 31(16) e94 (2003).

Microarrays

In this method, polynucleotide sequences of interest (including cDNAs and oligonucleotides) are arrayed on a substrate. The arrayed sequences are then contacted under conditions suitable for specific hybridization with detectably labeled cDNA generated from RNA of a sample. The source of RNA typically is total RNA isolated from a tumor sample, and optionally from normal tissue of the same patient as an internal control or cell lines. RNA can be extracted, for example, from frozen or archived paraffin-embedded and fixed (e.g. formalin-fixed) tissue samples.

For example, PCR amplified inserts of cDNA clones of a gene to be assayed are applied to a substrate in a dense array. Usually at least 10,000 nucleotide sequences are applied to the substrate. For example, the microarrayed genes, immobilized on the microchip at 10,000 elements each, are suitable for hybridization under stringent conditions. Fluorescently labeled cDNA probes may be generated through incorporation of fluorescent nucleotides by reverse transcription of RNA extracted from tissues of interest. Labeled cDNA probes applied to the chip hybridize with specificity to each spot of DNA on the array. After washing under stringent conditions to remove non-specifically bound probes, the chip is scanned by confocal laser microscopy or by another detection method, such as a CCD camera. Quantitation of hybridization of each arrayed element allows for assessment of corresponding mRNA abundance.

With dual color fluorescence, separately labeled cDNA probes generated from two sources of RNA are hybridized pair wise to the array. The relative abundance of the transcripts from the two sources corresponding to each specified gene is thus determined simultaneously. The miniaturized scale of the hybridization affords a convenient and rapid evaluation of the expression pattern for large numbers of genes. Such methods have been shown to have the sensitivity required to detect rare transcripts, which are expressed at a few copies per cell, and to reproducibly detect at least approximately two-fold differences in the expression levels (Schena et at, *Proc. Natl. Acad. Sci. USA* 93(2):106-149 (1996)). Microarray analysis can be performed on commercially available equipment, following the manufacturer's protocols, such as by using the Affymetrix GenChip® technology, or Incyte's microarray technology.

Isolating RNA from Body Fluids

Methods of isolating RNA for expression analysis from blood, plasma and serum (see for example, Tsui N B et al. (2002) *Clin. Chem.* 48, 1647-53 and references cited therein) and from urine (see for example, Boom R et al. (1990) *J Clin Microbiol.* 28, 495-503 and reference cited therein) have been described.

Immunohistochemistry

Immunohistochemistry methods are also suitable for detecting the presence of gene fusions and alternative spliced junctions and applied to the method disclosed herein. Antibodies (e.g., monoclonal antibodies) that specifically bind a gene product of a gene of interest can be used in such methods. The antibodies can be detected by direct labeling of the antibodies themselves, for example, with radioactive labels, fluorescent labels, hapten labels such as biotin, or an enzyme such as horse radish peroxidase or alkaline phosphatase. Alternatively, unlabeled primary antibody can be used in conjunction with a labeled secondary antibody specific for the primary antibody. Immunohistochemistry protocols and kits are well known in the art and are commercially available.

Proteomics

The term "proteome" is defined as the totality of the proteins present in a sample (e.g. tissue, organism, or cell culture) at a certain point of time. Proteomics includes, among other things, study of the global changes of protein expression in a sample (also referred to as "expression proteomics"). Proteomics typically includes the following steps: (1) separation of individual proteins in a sample by 2-D gel electrophoresis (2-D PAGE); (2) identification of the individual proteins recovered from the gel, e.g. my mass spectrometry or N-terminal sequencing, and (3) analysis of the data using bioinformatics.

General Description of the RNA Isolation and Preparation from Fixed, Paraffin-Embedded Samples for Whole Transcriptome Sequencing The steps of a representative protocol for profiling gene expression levels using fixed, paraffin-embedded tissues as the RNA source are provided in various published journal articles. (See, e.g., T. E. Godfrey et al., *J. Molec. Diagnostics* 2: 84-91 (2000); K. Specht et al., *Am. J. Pathol.* 158: 419-29 (2001), M. Cronin, et al., *Am J Pathol* 164:35-42 (2004)). Modified methods can used for whole transcriptome sequencing as described in the Examples section. Briefly, a representative process starts with cutting a tissue sample section (e.g. about 10 μm thick sections of a paraffin-embedded tumor tissue sample). The RNA is then extracted, and ribosomal RNA may be deleted as described in U.S. Pub. No. 2011/0111409. cDNA sequencing libraries may be prepared that are directional and allowed for single or paired-end sequencing using commercially available kits such as the ScriptSeg™ mRNA-Seq Library Preparation Kit (Illumina). The libraries may also be barcoded for multiplex sequencing using commercially available barcode primers such as the RNA-Seq Barcode Primers from Illumina. PCR is then carried out to generate the second strand of cDNA to incorporate the barcodes and to amplify the libraries. After the libraries are quantified, the sequencing libraries may be sequenced as described herein.

Kits of the Invention

The materials for use in the methods of the present invention are suited for preparation of kits produced in accordance with well known procedures. The present invention thus provides kits comprising agents, which may include primers and/or probes, for quantitating the level of the disclosed gene fusions or alternative spliced junctions or their expression products via methods such as whole transcriptome sequencing or RT-PCR for predicting prognostic outcome. Such kits may optionally contain reagents for the extraction of RNA from tumor samples, in particular, fixed paraffin-embedded tissue samples and/or reagents for whole transcriptome sequencing. In addition, the kits may optionally comprise the reagent(s) with an identifying description or label or instructions relating to their use in the methods of the present invention. The kits may comprise containers (including microliter plates suitable for use in an automated implementation of the method), each with one or more of the various reagents (typically in concentrated form) utilized in the methods, including, for example, pre-fabricated microarrays, buffers, the appropriate nucleotide triphosphates (e.g., dATP, dCTP, dGTP and dTTP; or rATP, rCTP, rGTP and UTP), reverse transcriptase, DNA polymerase, RNA polymerase, and one or more probes and primers of the present invention (e.g., appropriate length poly(T) or random primers linked to a promoter reactive with the RNA polymerase). Mathematical algorithms used to estimate or quantify prognostic information are also potential components of kits.

Reports

The methods of this invention are suited for the preparation of reports summarizing the findings of the methods of the present invention. A "report" as described herein, is an electronic or tangible document that includes elements that provide information of interest relating the presence of gene fusions in a sample, the presence of alternative spliced junctions in a sample, or a likelihood assessment and its results. A subject report can be completely or partially electronically generated, e.g., presented on an electronic display (e.g., computer monitor). A report can further include one or more of: 1) information regarding the testing facility; 2) service provider information; 3) patient data; 4) sample data; 5) an interpretive report, which can include various information including: a) indication; b) test data, where test data can include information regarding the presence of a gene fusion or alternative spliced junction of interest, and 6) other features.

The present invention therefore provides methods of creating reports and the reports resulting therefrom. The report may include a summary of the gene fusions or alternative spliced junctions, in the cells obtained from the patient's tumor sample. The report may include a prediction that the patient has an increased likelihood of breast cancer recurrence or the report may include a prediction that the subject has a decreased likelihood of breast cancer recurrence. The report may include a recommendation for a treatment modality such as surgery alone or surgery in combination with chemotherapy. The report may be presented in electronic format or on paper.

Thus, in some embodiments, the methods of the present invention further include generating a report that includes information regarding the patient's likelihood of long-term survival without breast cancer recurrence. For example, the methods of the present invention can further include a step of generating or outputting a report providing the results of a patient response likelihood assessment, which can be provided in the form of an electronic medium (e.g., an electronic display on a computer monitor), or in the form of a tangible medium (e.g., a report printed on paper or other tangible medium).

A report that includes information regarding the likelihood that a patient will exhibit breast cancer recurrence is provided to a user. An assessment as to the likelihood that a cancer patient will exhibit breast cancer recurrence is referred to as a "likelihood assessment." A person or entity who prepares a report ("report generator") may also perform the likelihood assessment. The report generator may also perform one or more of sample gathering, sample processing, and data generation, e.g., the report generator may also perform one or more of: a) sample gathering; b) sample processing; and c) determining the presence of a gene fusion or an alternative spliced junction. Alternatively, an entity other than the report generator can perform one or more sample gathering, sample processing, and data generation.

The term "user" or "client" refers to a person or entity to whom a report is transmitted, and may be the same person or entity who does one or more of the following: a) collects a sample; b) processes a sample; c) provides a sample or a processed sample; and d) generates data for use in the likelihood assessment. In some cases, the person or entity who provides sample collection and/or sample processing and/or data generation, and the person who receives the results and/or report may be different persons, but are both referred to as "users" or "clients." In certain embodiments, e.g., where the methods are completely executed on a single computer, the user or client provides for data input and review of data output. A "user" can be a health professional (e.g., a clinician, a laboratory technician, a physician (e.g., an oncologist, surgeon, pathologist), etc.).

In embodiments where the user only executes a portion of the method, the individual who, after computerized data processing according to the methods of the invention, reviews data output (e.g., results prior to release to provide a complete report, a complete, or reviews an "incomplete" report and provides for manual intervention and completion of an interpretive report) is referred to herein as a "reviewer." The reviewer may be located at a location remote to the user (e.g., at a service provided separate from a healthcare facility where a user may be located).

Where government regulations or other restrictions apply (e.g., requirements by health, malpractice, or liability insurance), all results, whether generated wholly or partially electronically, are subjected to a quality control routine prior to release to the user.

Computer-Based Systems and Methods

The methods and systems described herein can be implemented in numerous ways. In one embodiment of the invention, the methods involve use of a communications infrastructure, for example, the internet. Several embodiments of the invention are discussed below. The present invention may also be implemented in various forms of hardware, software, firmware, processors, or a combination thereof. The methods and systems described herein can be implemented as a combination of hardware and software. The software can be implemented as an application program tangibly embodied on a program storage device, or different portions of the software implemented in the user's computing environment (e.g., as an applet) and on the reviewer's computing environment, where the reviewer may be located at a remote site (e.g., at a service provider's facility).

In an embodiment of the invention, during or after data input by the user, portions of the data processing can be performed in the user-side computing environment. For example, the user-side computing environment can be programmed to provide for defined test codes to denote a likelihood "score," where the score is transmitted as processed or partially processed responses to the reviewer's computing environment in the form of test code for subsequent execution of one or more algorithms to provide a result and/or generate a report in the reviewer's computing environment. The score can be a numerical score (representative of a numerical value) or a non-numerical score representative of a numerical value or range of numerical values (e.g., "A": representative of a 90-95% likelihood of a positive response; "High": representative of a greater than 50% chance of a positive response (or some other selected threshold of likelihood); "Low": representative of a less than 50% chance of a positive response (or some other selected threshold of likelihood), and the like.

As a computer system, the system generally includes a processor unit. The processor unit operates to receive information, which can include test data (e.g., the presence of a gene fusion or an alternative spliced junction) and may also include other data such as patient data. This information received can be stored at least temporarily in a database, and data analyzed to generate a report as described above.

Part or all of the input and output data can also be sent electronically. Certain output data (e.g., reports) can be sent electronically or telephonically (e.g., by facsimile, using devices such as fax back). Exemplary output receiving devices can include a display element, a printer, a facsimile device and the like. Electronic forms of transmission and/or display can include email, interactive television, and the like. In an embodiment of the invention, all or a portion of the input data and/or output data (e.g., usually at least the final report) are maintained on a web server for access, preferably confidential access, with typical browsers. The data may be accessed or sent to health professionals as desired. The input and output data, including all or a portion of the final report, can be used to populate a patient's medical record that may exist in a confidential database as the healthcare facility.

The present invention also contemplates a computer-readable storage medium (e.g., CD-ROM, memory key, flash memory card, diskette, etc.) having stored thereon a program which, when executed in a computing environment, provides for implementation of algorithms to carry out all or a portion of the results of a likelihood assessment as described herein. Where the computer-readable medium contains a complete program for carrying out the methods described herein, the program includes program instructions for collecting, analyzing and generating output, and generally includes computer readable code devices for interacting with a user as described herein, processing that data in conjunction with analytical information, and generating unique printed or electronic media for that user.

Where the storage medium includes a program that provides for implementation of a portion of the methods described herein (e.g., the user-side aspect of the methods (e.g., data input, report receipt capabilities, etc.)), the program provides for transmission of data input by the user (e.g., via the internet, via an intranet, etc.) to a computing environment at a remote site. Processing or completion of processing of the data is carried out at the remote site to generate a report. After review of the report, and completion of any needed manual intervention, to provide a complete report, the complete report is then transmitted back to the user as an electronic document or printed document (e.g., fax or mailed paper report). The storage medium containing a program according to the invention can be packaged with instructions (e.g., for program installation, use, etc.) recorded on a suitable substrate or a web address where such instructions may be obtained. The computer-readable storage medium can also be provided in combination with one or more reagents for carrying out a likelihood assessment (e.g., primers, probes, arrays, or such other kit components).

Having described the invention, the same will be more readily understood through reference to the following Examples, which are provided by way of illustration, and are not intended to limit the invention in any way. All citations through the disclosure are hereby expressly incorporated by reference.

Example 1

Materials and Methods—Providence Cohort

Patients

One hundred and thirty-six primary breast cancer FFPE tumor specimens with clinical outcomes were provided by Providence St. Joseph Medical Center (Burbank, Calif.), with institutional review board approval. The time to first recurrence of breast cancer or death due to breast cancer (including death due to unknown cause) was determined from these records. Patients who were still alive without breast cancer recurrence or who died due to known other causes were considered censored at the time of last follow-up or death. These tumor specimens were used for biomarker discovery in the development of the Oncotype DX® assay. See e.g., U.S. Pat. No. 7,081,340; S. Paik et al., *The New England Journal of Medicine* 351, 2817 (2004). For the present study, 136 specimens had adequate RNA remaining. Among the 136 patients, 26 experienced breast cancer recurrence or death due to breast cancer. Clinical characteristics of the patients in the Providence cohort are described in Sinicropi et al., *PLoS ONE* 7(7):e40092 (2012) which is incorporated by reference in its entirety.

RNA-Seq Sample Preparation and Sequencing

Transcriptome RNA-Seq analysis of the Providence cohort is described in Sinicropi et al., *PLoS ONE* 7(7): e40092 (2012). Total RNA was prepared from three 10-μm-thick sections of FFPE tumor tissue as previously described using the MasterPure™ Purification Kit (Epicentre® Biotechnologies, Madison, Wis.). M. Cronin et al., *The American Journal of Pathology* 164, 35 (January 2004). One hundred nanograms of the isolated RNA were depleted of ribosomal RNA as described. See U.S. Pub. No. 2011/0111409. Sequencing libraries for whole transcriptome analysis were prepared using ScriptSeq™ mRNA-Seq Library Preparation Kits (Epicentre® Biotechnologies, Madison, Wis.). During the cDNA synthesis step, additional incubation for 90 minutes at 37° C. was implemented in the reverse transcription step to increase library yield. After 3'-terminal tagging, the di-tagged cDNA was purified using MinElute® PCR Purification Kits (Qiagen, Valencia, Calif.). Two 6 base index sequences were used to prepare barcoded libraries for duplex sequencing (RNA-Seq Barcode Primers; Epicentre® Biotechnologies, Madison, Wis.). PCR was carried out through 16 cycles to generate the second strand of cDNA, incorporate barcodes, and amplify libraries. The amplified libraries were size-selected by a solid phase reversible immobilization, paramagnetic bead-based process (Agencourt® AMPure® XP System; Beckman Coulter Genomics, Danvers, Mass.). Libraries were quantified by PicoGreen® assay (Life Technologies, Carlsbad, Calif.) and visualized with an Agilent Bioanalyzer using a DNA 1000 kit (Agilent Technologies, Waldbronn, Germany).

Two RNA-Seq libraries with different index barcodes were loaded into each lane of flow cells. The cluster generation in flow cells was carried out in an Illumina cBOT™ instrument using TruSeq™ SR Cluster Kits v2 following the manufacturer's protocol (Illumina Inc.; San Diego, Calif.). The flow cells were subsequently transferred to an Illumina HiSeq®2000 instrument (Illumina, Inc.) for sequence analysis using TruSeq SBS Kit v3-HS (50 cycles) following the manufacturer's protocol. The single-read runs were carried out for a total of 57 cycles including 7 cycles for the index sequences and 50 cycles (i.e. 50 bases) for the insert sequences.

Data Quality Assessment

Each sequencing lane was duplexed with two patient sample libraries using a 6 base barcode to differentiate between them. The mean read ratio+/−SD between the two samples in each lane was 1.05±0.38 and the mean+/−SD percentage of un-discerned barcodes was 2.08%±1.63%. Using principal components analysis and other exploratory data analysis methods, no systematic differences were found among samples associated with flow cell or barcode.

In a run-in phase of the study, duplicate libraries were prepared for 8 samples selected at random from the study set of 136. RefSeq RNA coverage for these libraries ranged between 3.1M and 6.7M uniquely mapped reads. Log count Pearson correlations among duplicate libraries ranged between 0.947 and 0.985. Single libraries were prepared for the remaining 128 samples and distributed in duplex mode among the lanes of 8 flow-cells. Sequencing in 3 lanes failed. Two libraries had low yield, resulting in low coverage. Three lanes were flagged by various Illumina process monitoring indices: low Q30 (coverage=2.8M and 4.2M), high cluster density (coverage=1.6M and 1.8M), or inadequate imaging (coverage=3.3M and 3.1M). For the remaining lanes, sample coverage ranged between 2.5M and 7.3M reads. New libraries for the samples that had low yield were prepared and sequenced. Libraries in the failed and flagged lanes, as well as some of the low coverage samples, were re-sequenced. Replicate correlations among all sequenced samples were very high, 0.985 for the samples with the high cluster density in the original run, and over 0.990 for all others. For the analysis data set, data for one of each of the duplicate libraries from the run-in experiment were kept. For the samples for which new libraries were prepared and for the samples in the failed and flagged lanes, the reads from the subsequent run were used. For the samples with low coverage for which the library was reprocessed, reads from the two runs were pooled. For the rest of the samples, the reads from the single lane were used. Results differed little when other data analysis procedures were used, for example, using only the second run when libraries were reprocessed.

Example 2

Rush Cohort 78 patient samples as described in Cobleigh et al., *Clin. Cancer Res.* 11:8623-8631 (2005) and in U.S. Pat. No. 7,569,345 were obtained from women with invasive breast cancer and ≥10 positive nodes with no evidence of metastatic disease who had surgery at Rush University Medical Center from 1979 to 1999. Clinical outcome data were available for all patients. Patients who were still alive without breast cancer recurrence or who died due to known other causes were considered censored at the time of last follow-up or death. For the present study, 76 specimens had adequate RNA remaining for RNA-Seq.

Example 3

Bioinformatics Approach to Identifying Gene Fusions

Figure 1A:
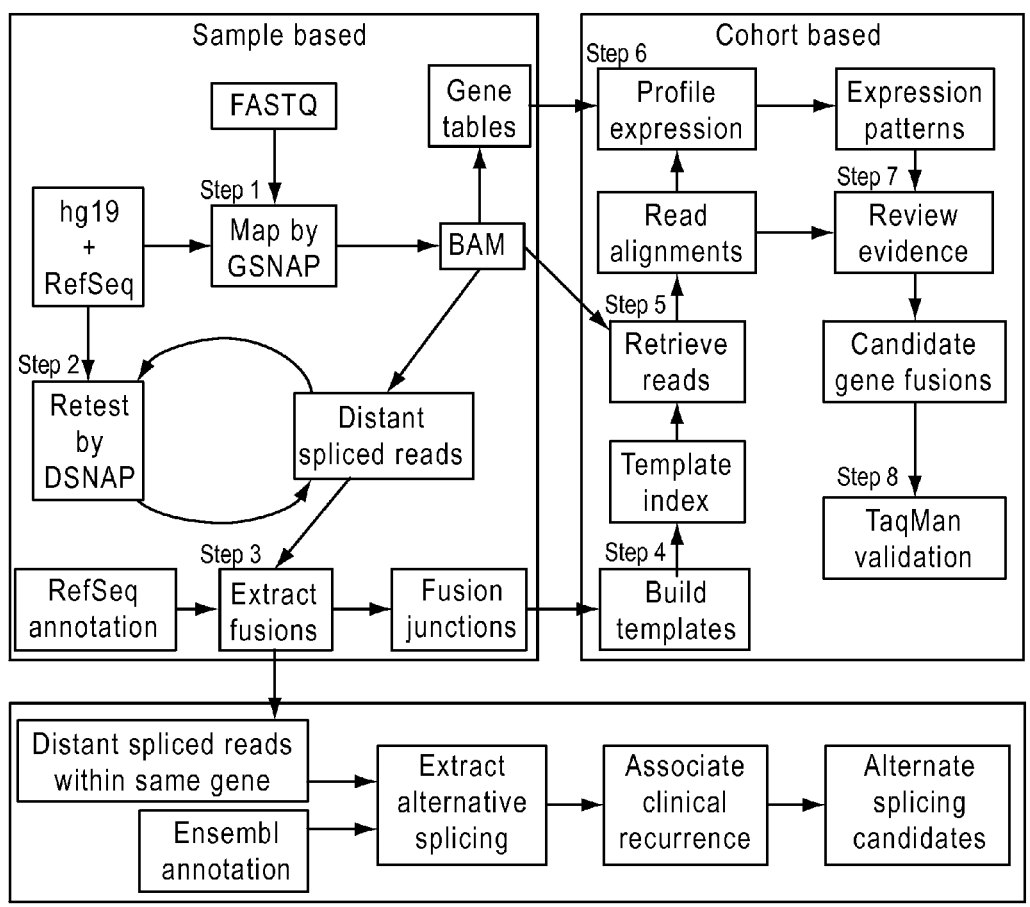
FIG. 1A shows an overview of the bioinformatics method for identifying a gene fusion and the bioinformatics method for identifying alternatively spliced genes from RNA sequencing data.
Figure 1B:
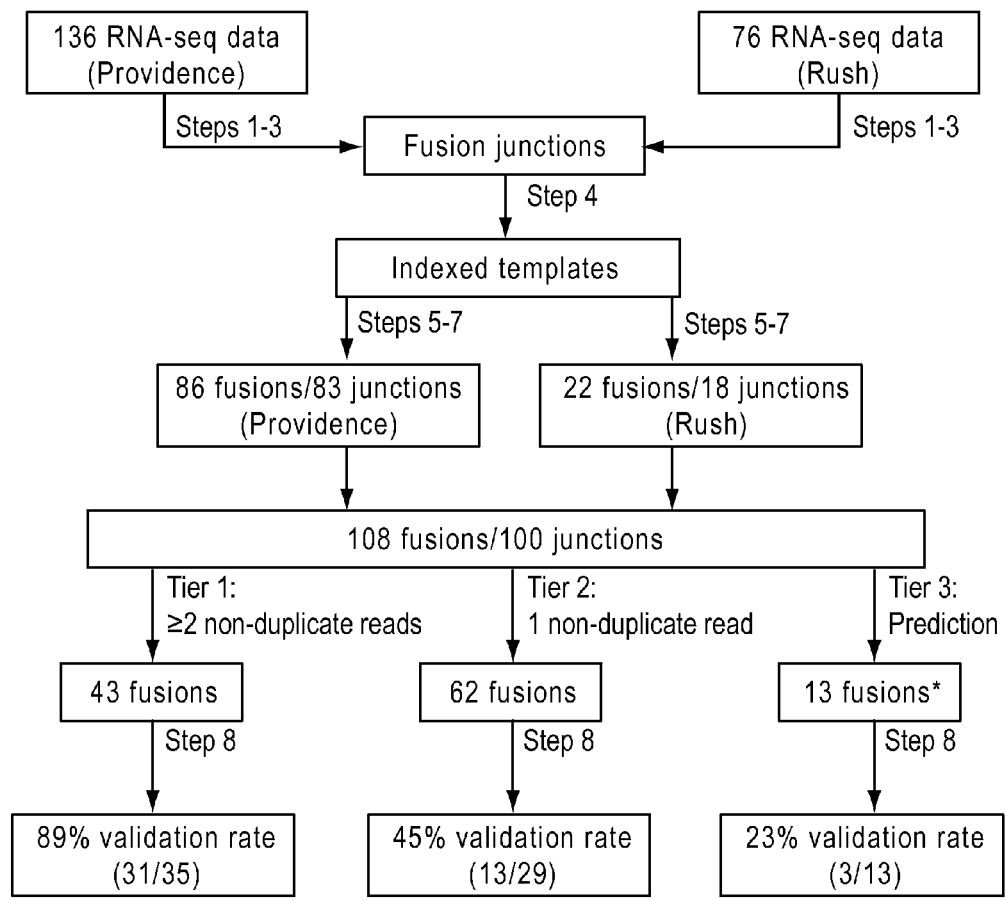
FIG. 1B shows classification of candidate fusions into 3 tiers based on the levels of supporting evidence.

An overview of the bioinformatics approach used to identify gene fusions in samples from the Providence and Rush cohorts is depicted in FIG. 1A. The pipeline was developed in LINUX SHELL, PERL or R languages, and the data processing was on LINUX clusters. Data from the Providence and Rush cohorts was assessed separately in Steps 1-3, which are described herein. In Step 4, data from the Providence and Rush were merged together. However the expression profiling step was carried out separately within each cohort considering inter-cohort differences in block archive ages and library quality (FIG. 1B).

The underlying gene fusion method is based on the detection of distant splicing within a single read feature of a RNA-seq aligner GSNAP (Wu, T. D. and Nacu, S. (2010) Fast and SNP-tolerant detection of complex variants and splicing in short reads. *Bioinformatics*, 26, 873-881). The utility of GSNAP for gene fusion detection has been demonstrated in gene fusion detection methods such as GSTRUCT-fusions and GFP (Seshagiri, S. et al. (2012) Recurrent R-spondin fusions in colon cancer. *Nature*, 488, 660-664; Ju, Y. S. et al. (2012) A transforming KIF5B and RET gene fusion in lung adenocarcinoma revealed from whole-genome and transcriptome sequencing. *Genome Res.*, 22, 436-445). Both methods depend on GSNAP to provide fusion read candidates, and apply a set of filtering modules to remove false positives in paired-end RNA-seq datasets. In RNA-seq paired end libraries prepared from fresh frozen tissue, bridging reads mapped to each side of fusion junction sites provide a very powerful filter in both GSTRUCT and GFP approaches, therefore single end read datasets are disadvantaged. To compensate for the short FFPE RNA length with median library size around 100 bp in Providence, we leverage data from the two patient cohorts as shown in FIG. 1A. The sample based strategy analyzes each RNA-seq sample individually and nominates candidate fusion junctions for the following cohort based strategy, which confirms the presence of each of fusion candidates in each individual sample across the whole cohort by examining read alignment and expression profiling evidence. To increase the possibilities of identifying recurrent gene fusions across the two cohorts studied here, fusion candidate templates provided by the sample based strategy from both Providence and Rush were merged together in the beginning step of the cohort based strategy (FIG. 1B). However the expression profiling step was carried out separately within each cohort considering inter-cohort differences in block archive ages and library quality (FIG. 1B). The insert size and complexity of the Providence cohort libraries is higher than that of the Rush cohort libraries, so here we describe results from the Providence RNA-seq dataset (Sinicropi, D. et al. (2012) Whole Transcriptome RNA-Seq Analysis of Breast Cancer Recurrence Risk Using Formalin-Fixed Paraffin-Embedded Tumor Tissue. *PLoS ONE*, 7, e40092) to illustrate the performance of the cohort based computational approach.

Step 1: Mapping FASTQ Files to the Human Genome Using GSNAP

Raw sequencing data from the Providence and Rush cohorts were converted to FASTQ files using CASAVA software. The FASTQ files were mapped to the human genome (version GHCh37/hg19) along with RefSeq splicing sites using the RNA-Seq aligner GSNAP. An important feature of GSNAP is its ability to detect a distant spliced junction within a single read. Local spliced junctions derive from splicing events within a single gene in a consistent transcription direction, whereas distant sliced junctions derive from splicing events between different genes or chromosomes. Distant splicing events can also include splicing events occurring within the same gene, but in the opposite transcription direction. Distant splicing events, therefore, include translocations, inversions, and the like.

Two filters were installed to remove low quality and unwanted reads. Good quality reads were identified as reads in which at least 30% of the bases have Sanger quality score 20 or above. Reads failing this threshold were flagged as low-quality and removed from alignment (BAM) files. Simultaneously, a number of abundant sequences including biological sequences (e.g., ribosomal RNA and mitochondrial sequences), and sequences introduced during library prep (e.g., phiX), were considered undesirable for gene fusion detection and were removed from alignment (BAM) files. Only reads passing both filtering thresholds and uniquely mapped to human genome were retained for the further analyses. Such reads were considered distant spliced reads.

The uniquely mapped reads in the cleaned BAM files were converted to (non-normalized) gene feature counts that provide expression values for exonic, intronic, and intergenic regions. The gene feature count is the number of aligned bases from reads mapped within the feature region. The gene level expression values were calculated by aggregating counts for exonic or intronic features. These gene feature counts are referred to as "gene tables" in FIG. 1.

Step 2: Retesting Reads Using GSNAP

In order to remove false positives, reads that mapped to the human genome in Step 1 were retested using GSNAP parameters that favor local alignment. Each alignment from the GSNAP rerun was examined, and any reads meeting all following criteria were considered as having false positive distant splicing reads in the original GSNAP output, and thus removed for the further analyses: (1) the total matched length was 44 bp or more; (2) the insertion length was 1 bp or 0; and (3) the deletion length was 1 bp or 0. For the Providence cohort, Step 2 filtered out 18% of the distant spliced junctions. Reads that successfully passed through this step were considered to include a distant spliced junction.

Step 3: Extracting Gene Fusions

In Step 3, the resulting distant splicing junctions were then annotated and candidate gene fusions were selected. Specifically, the alignments of reads that passed GSNAP re-testing step were examined, and reads with any mismatches within 5 bp of the distant splicing junction site or mapped to the anti-sense strand of annotated genes were removed from further analyses. The remaining reads were grouped according to the distant splicing junction sites, and each junction site was annotated based on UCSC refseq sequence annotation. Junctions mapped to a pseudogene or multiple mapped refseq genes were removed. At this stage, candidate gene fusions met one of the following criteria: (1) they mapped to different chromosomes; (2) they mapped to different refseq genes; (3) they were in opposite directions on same chromosome; or (4) they were at least 1 MB apart if on the same chromosome. For the Providence cohort, Step 3 filtered out 20% of the distant spliced junctions. Steps 1-3 make up the sample based approach identified in FIG. 1.

Step 4: Building Templates

Figure 2:
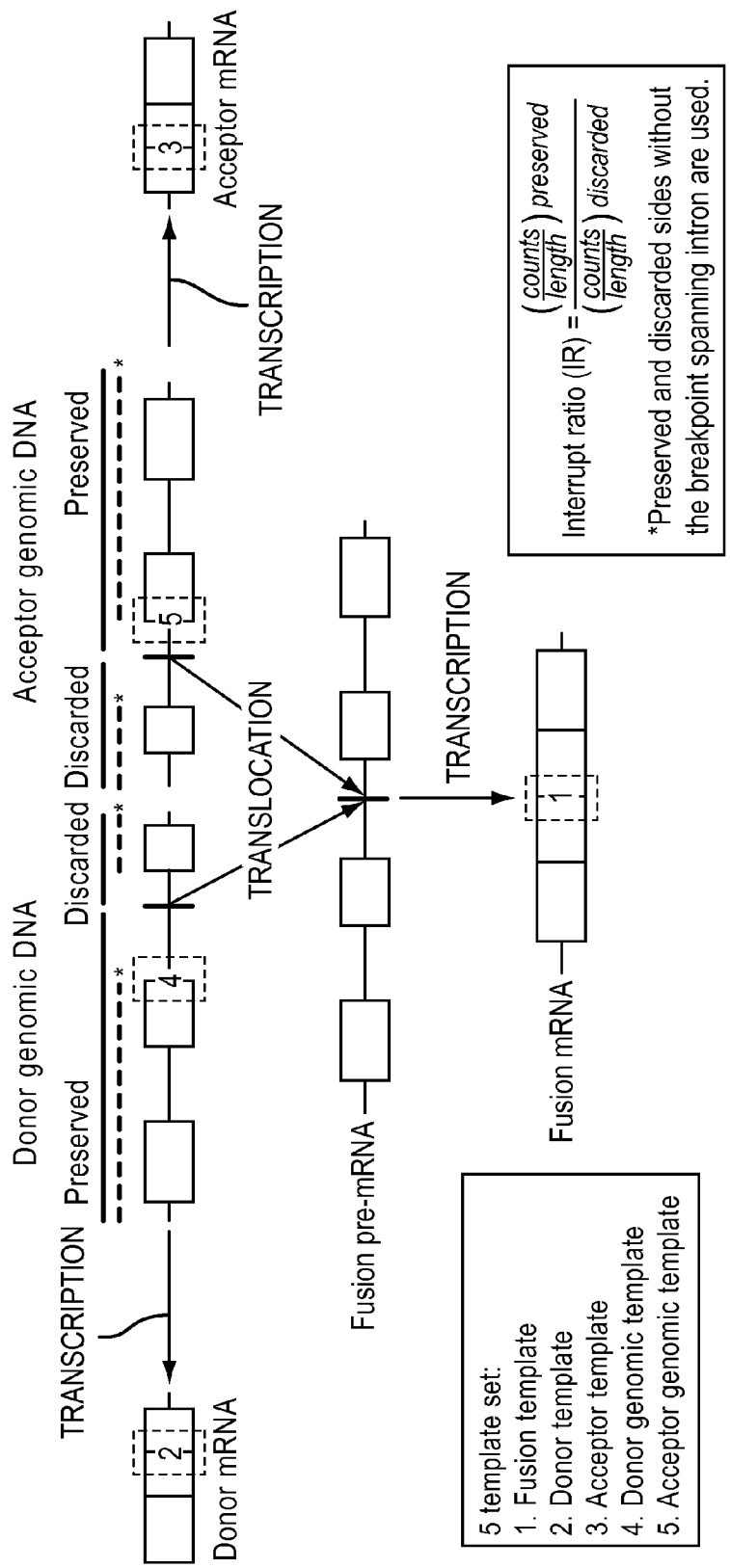
FIG. 2 depicts the individual templates present in the five template set described in Example 3: (1) fusion template; (2) donor template; (3) acceptor template; (4) donor genomic template; and (5) donor acceptor template.

A five template set was created to remove false positives introduced by homologous template sequences and to enable accurate mapping of supporting reads. At this stage, information from both the Providence and Rush cohorts was combined. The features of the five template set are depicted in FIG. 2. The five template set included the following individual templates, each of which included 100 bp:

1. Fusion template: The 50 bp exonic sequence of the preserved region of donor gene plus 50 bp exonic sequence of the preserved region of acceptor gene,
2. Donor template: The 50 bp exonic sequence of the preserved region of donor gene plus 50 bp exonic sequence of the discarded region of donor gene,
3. Acceptor template: The 50 bp exonic sequence of the discarded region of acceptor gene plus 50 bp exonic sequence of the preserved region of acceptor gene,
4. Donor genomic template: The 50 bp upstream genomic sequence of donor splicing site plus 50 bp downstream genomic sequence of donor splicing site, and
5. Acceptor genomic template: The 50 bp upstream genomic sequence of acceptor splicing site plus 50 bp downstream genomic sequence of acceptor splicing site.

Donor and acceptor exon only or genomic containing template sequences were used as controls. The sequence of each template in the 5 template set was retrieved and annotated for each candidate gene fusion. Candidate gene fusions were considered to be false positives and were removed if any of its templates had the identical sequence, but were mapped to different locations on the human genome.

BLAST was used to investigate the homology of the remaining candidate gene fusions. A second five template set for each of the remaining candidate gene fusions was created. This template included the following individual templates, each of which included 300 bp:

a. Fusion template: The 150 bp exonic sequence of the preserved region of donor gene plus 150 bp exonic sequence of the preserved region of acceptor gene,
b. Donor template: The 150 bp exonic sequence of the preserved region of donor gene plus 150 bp exonic sequence of the discarded region of donor gene,
c. Acceptor template: The 150 bp exonic sequence of the discarded region of acceptor gene plus 150 bp exonic sequence of the preserved region of acceptor gene,
d. Donor genomic template: The 150 bp upstream genomic sequence of donor splicing site plus 150 bp downstream genomic sequence of donor splicing site, and
e. Acceptor genomic template: The 150 bp upstream genomic sequence of acceptor splicing site plus 150 bp downstream genomic sequence of acceptor splicing site.

Homology between (b) the donor template and (c) the acceptor template and between (d) the donor genomic template and (e) the acceptor genomic template was evaluated. The fusion template (a) was used to provide sequence information for RT-PCR experiments. Any candidate gene fusion meeting the following criteria was removed from further analysis: (1) sequence identity of more than 14 bp of 300 bp of the donor template and acceptor template; (2) sequence identity of more than 14 bp of 300 bp of the donor genomic template and acceptor genomic template; and (3) less than 50 bp exonic sequence on either side of fusion, donor, or acceptor template sequences. This step removed 27% of the candidate gene fusions from the Providence cohort.

Step 5: Retrieving Reads

The templates from the remaining candidate gene fusions from both the Providence and the Rush cohorts were used to create a genomic index using a tool from the GSNAP package. Based on the genomic location of all candidate fusion template sets, all short reads mapped near any junction sites and reads not mapped in the original GSNAP BAM file per RNA-seq library were selected. The selected reads were re-mapped into the built template genomic index by GSNAP with the splicing detection parameter turn off. The alignments between supporting reads and fusion templates were screened to allow minimum of 5 bp exact match sequence as overhang across the junction site.

Only reads uniquely mapped to the fusion template were kept. Reads were examined according to the below parameters to determine if they mapped to the fusion template with good quality: (1) no mismatch around 5 bp of junctions of any template; (2) number of reads with indels is no more than 75% of all reads mapped to a given template; (3) reads with splicing evidence in the original BAM files were not allowed to be mapped to fusion template; (4) no splicing or distant splicing allowed on these 100 bp template sequences; (5) no soft clipping of more than 3 bp on each read side; (6) no deletion more than 1 bp at a given indel location; and (7) no insertion more than 1 bp at a given indel location. Step 5 filtered out 5% of the candidate gene fusions from the Providence cohort.

FIG. 3 shows output reads for the gene fusions listed in Tables A and B. Because there were several gene fusion junctions having the same sequence, FIG. 3 shows information regarding 105 gene fusion junctions while Tables A and B list 100 gene fusion candidates.

Step 6: Expression Profiling

Expression profiles provide additional evidence for gene fusions. The utilization of expression data for gene fusion detection is a feature of the COPA (Cancer Outlier Profiling Analysis) method that was devised for analysis of microarray databases (Tomlins et al., 2005). Cancer related genes identified as expression outliers in microarray experiments led to the discovery of TMPRSS2 to ETS transcription factors, the first known recurrent gene fusions in common solid carcinomas. Gene fusion RNAs are expected to exhibit a marked expression discontinuity between the preserved side and discarded side of a given fusion junction, compared to samples without that gene fusion. Recently published gene fusions detected using RNA-seq have displayed this discrete expression pattern at acceptor fusion junction sites under RNA-seq platform (Lipson, D. et al. (2012) Identification of new ALK and RET gene fusions from colorectal and lung cancer biopsies. *Nature Medicine,* 18, 382-384; Ju, Y. S. et al. (2012) A transforming KIF5B and RET gene fusion in lung adenocarcinoma revealed from whole-genome and transcriptome sequencing. *Genome Res.,* 22, 436-445). Multiple bioinformatics approaches including FusionSeq (Sboner, A. et al. (2010) FusionSeq: a modular framework for finding gene fusions by analyzing paired-end RNA-sequencing data. *Genome Biol,* 11, R104), deFuse (McPherson, A. et al. (2011) deFuse: An Algorithm for Gene Fusion Discovery in Tumor RNA-Seq Data. *PLoS Comput Biol,* 7) and TopHat-Fusion (Kim, D. and Salzberg, S. L. (2011) TopHat-Fusion: an algorithm for discovery of novel fusion transcripts. *Genome Biol,* 12, R72) have used expression data in their pipelines. However all these methods are based on an analysis of subjects, one by one. The cohort-based approach described here compares expression levels across the cohort of subjects to find expression outliers as well as exon/intron level expression interruption corresponding to matching fusion junctions. Due to the large proportion of sequences that map to introns in FFPE RNA-seq data (Sinicropi, D. et al. (2012) Whole Transcriptome RNA-Seq Analysis of Breast Cancer Recurrence Risk Using Formalin-Fixed Paraffin-Embedded Tumor Tissue. *PLoS ONE,* 7, e40092), introns were used along with exons to enhance expression measurements. The expression profiling step can nominate candidate fusions despite the existence of very limited reads. In fact, here we used the expression profile data to predict known fusions in samples having no detected fusion sequences Methods for expression profiling included the following: The gene table described in Step 1 was normalized by scaling factors as described by R package DEseq, which is available at http://bioconductor.org/packages/release/bioc/html/DESeq.html). Anders and Huber, *Genome Biology* 11:R106 (2010). The intron immediately before the splicing site on the acceptor gene and the intron immediately after the splicing site on the donor gene were identified and excluded from expression analyses. The remaining exons and introns were analyzed and classified as either discarded or preserved based on their expression level. Discarded exons and introns having counts below 250 were padded to 250. Such counts were equivalent to 5 reads prior to normalization. The gene feature (exon or exon/intron) counts were normalized by the sequence length. The expression interrupt ratios of normalized counts between preserved and discarded sides were calculated for donor and acceptor genes for each sample according to the following formula:

$$IR = \frac{\left(\frac{counts}{length}\right)\text{preserved}}{\left(\frac{counts}{length}\right)\text{discarded}}$$

As an exemplary case, the fusion RABEP1→DNAH9 (a tier 1 fusion) was initially found in a single Providence sample and was supported by two non-redundant reads across the fusion template (FIG. 3.7). There are multiple reads across the donor RABEP1 mRNA template junction and no reads across the acceptor DNAH9 mRNA template junction. The same trend exists in pre-mRNA templates, therefore it suggests the strong donor promoter drives the expression of fusion transcripts which appear as one of two expression outliers in the Providence cohort. When the exon/intron expression levels of acceptor DNAH9 were examined across Providence, the other expression outlier appears to have the same discrete expression pattern which exists in the sample but no other samples. The individual exon/intron expression levels of DNAH9 also agree with the observation from the heatmap (data not shown). Therefore we predicted the sample has a tier 3 fusion RABEP1→DNAH9 although there are no reads across fusion junction in that sample. Both fusion events were validated by TaqMan with an average CT of 30.11 and 34.86 respectively (Table 1). This prediction succeeded due to the fact that the fusion transcript is the prevalent form over the non-fused acceptor transcript (FIG. 3.7).

Expression profiling results for the candidate gene fusions are shown in FIG. 4. FIG. 4 shows a scatter plot of normalized gene level counts for the indicated donor and acceptor genes. FIG. 4 also shows bar plots of normalized counts of each exon and intron of acceptor gene of the identified samples in the order of their genomic location. The vertical line separates the acceptor gene into discarded and preserved sides. Because there were several gene fusion junctions having the same sequence, FIG. 4 shows information regarding 105 gene fusion junctions.

Step 7: Review Evidence

Data were manually reviewed to identify candidate gene fusions. The following rules were used to select the final candidate gene fusions: (1) multiple samples sharing the same hits, but without good expression evidence were removed; (2) fusions with a minimum of two non-duplicate reads and a minimum of 15 bp overhang were kept; and (3) expression profiling evidence was reviewed to select candidates with favorable expression evidence. Steps 4-7 make up the cohort based approached identified in FIG. 1.

Gene Fusion List

Overall, 108 fusion events consisting of 100 unique fusion junctions were identified in the two cohorts (Tables A and B). Table A provides information regarding the cohort, the fusion junction, the fusion genes, COSMIC gene, donor Entrez gene ID, donor gene type, donor HUGO gene symbol, donor gene description, acceptor Entrez gene ID, acceptor gene type, acceptor HUGO gene symbol, and acceptor gene description. The symbol "→" indicates the splicing direction of the gene fusion. The symbol "_" is used interchangeably with the symbol "→" to denote junctions in the figures and tables. Splice donors are located to the left of the arrow and splice acceptors are located to the right of the arrow. The "+" symbol denoted in the junctions, refers to the plus-strand of the chromosome, whereas the "−" symbol denotes the minus-strand of the chromosome. Table B provides the gene fusion and the nucleotide sequence of the 100 unique gene fusions.

The majority of gene fusions are intra-chromosomal genomic rearrangements (69 out of total 100 fusion junctions), and this is consistent with findings of others (Robinson, D. R. et al. (2011) Functionally recurrent rearrangements of the MAST kinase and Notch gene families in breast cancer. Nature Medicine, 17, 1646-1651; Edgren, H. et al. (2011) Identification of fusion genes in breast cancer by paired-end RNA-sequencing. Genome Biol, 12, R6. Of the 100 unique fusions, only TFG→GPR128 has been discovered previously (Mitelman, F. et al. (2012) Mitelman Database of Chromosome Aberrations and Gene Fusions in Cancer; Asmann, Y. W. et al. (2012) Detection of Redundant Fusion Transcripts as Biomarkers or Disease-Specific Therapeutic Targets in Breast Cancer. Cancer Res, 72, 1921-1928). It is noteworthy that some of these rare fusions are detected in both of the examined patient cohorts. Here, we validated 3 recurrent gene fusions including TFG-→GPR128, ESR1→AKAP12 and RABEP1→DNAH9 by TaqMan assay using amplified RNA from 6, 3 and 2 patients respectively in the two cohorts of 212 total patients. Interestingly, among three ESR1→AKAP12 fusion events in three different patients, there are two unique fusion junctions sharing the same acceptor junction site but differing at the donor junction sites by one exon. Since both ESR1→AKAP12 fusion junctions are in frame and the differed ESR1 exon doesn't harbor any known functional domains, these two fusion transcripts can be assumed possessing the same biological function. Further protein domain analysis showed both fusion proteins replace ESR1 ligand binding site with functional domains of AKAP12 (FIG. 9). Interestingly, the lost ligand binding site interacts with another AKAP family member AKAP13. (Rubino, D. et al. (1998) Characterization of Brx, a novel Dbl family member that modulates estrogen receptor action. Oncogene, 16, 2513-2526). Both fusion protein isoforms could potentially cause constitutive ligand-independent signaling, therefore disregulate protein kinase A pathway (FIG. 9). On the other hands, we also identified some different junctions between two identical fused partners within a single patient. One Providence patient has three different ERBB2→IKZF3 junctions, which only differ at the donor junction site, and one Rush patient has two different TRIM37→BCAS3 junctions which only differ at the donor junction site (see Table 3, below).

Also, multiple recurrent partners fused to different partners were found within the two cohorts. In the Providence sample harboring ESR1→AKAP12, another fusion ESR1→C6orf211 was found and validated, it suggests multiple copies of ESR1 existed and they were fused to different acceptors. LRP5 was also found and validated to be fused to different acceptors KAT6A and SLC22A24 in the same patient. However ADK was found and validated to be an acceptor in the fusion DLG5→ADK in one patient, and a donor in the fusion ADK→C10orf11 in another patient. Similarly, the gene ACACA was also found and validated as the donor of ACACA→M512 in one patient, and the acceptor of UTP18→ACACA in another patient. We further searched the Mitelman fusion database with all 184 unique fusion partners including donors and acceptors from the final 108 fusion list, and 29 partners were found fused to various different partners in the database (Mitelman, F. et al. (2012) Mitelman Database of Chromosome Aberrations and Gene Fusions in Cancer). Among them, ACACA, BCAS3, DDX5, FBXL20, IKZF3, RAF1, TFG and TRPS1 were fused to more than one partner in the database. These observations suggest fusion events are unlikely random although they appear to be rare in solid tumors.

The identified fusion partners also tend to be cancer related, and 82% of the total 83 gene fusions identified from the Providence cohort have at least one partner belonging to COSMIC database which contains many frequently altered cancer specific genes. This is consistent with other evidence for frequently mutated genes prone to genomic rearrangements in the cancer genomes (Ju, Y. S. et al. (2012) A transforming KIF5B and RET gene fusion in lung adenocarcinoma revealed from whole-genome and transcriptome sequencing. Genome Res., 22, 436-445). The discovery of gene fusions containing partners that regulate repair of DNA double-strand breaks and homologous recombination such as RAD21, RDM1, BRCA2 and SHFM1 is consistent with abundant evidence for DNA replication infidelity in cancer.

Example 4

Validation of the Candidate Gene Fusions 60 of the 100 fusion junctions were selected based on cancer relevance of fused partner genes, and tested by quantitative RT-PCR assay (TaqMan®) using amplified RNA samples from selected patients harboring corresponding candidate fusions. Reverse transcription was carried out using the Omniscript™ RT Kit (Qiagen) by incubating amplified RNA with random hexamers and gene-specific primers at 37° C. for 1 hour. Primer, probe, and amplicon sequences are shown in Supplementary Table 2. Fluorogenic probes were dual-labeled with 5'-FAM as a reporter and 3'-BHQ-2 as a quencher. Primers and probes were designed using the Primer3 program restricting amplicon sizes to 65-85 bps (http://frodo.wi.mit.edu/). When Primer3 failed, primer and probe sequences were optimized manually to ensure optimal performance of the TaqMan® assay design for the chimeric transcripts. Reverse transcription reaction in the absence of RNA template (i.e., water) was always used as a negative control in all assays. The samples that were previously validated as positive or negative for a particular gene fusion junction were served as controls when needed. Since the RT reaction was multiplexed by using a pooled gene specific primer set, the cDNA derived from a RNA sample was tested with all fusion gene qPCR assays within a validation gene set. All RNA samples were assayed in triplicate qPCR reactions with 10 ul per well. Thermalcycling conditions were standard for all assays (A heat activation step of 95° C. for 10 minutes followed by 40 cycles of 95° C. for 20 seconds and 60° C. for 45 seconds). Table C indicates the fusion genes, the fusion junction, primer design method, amplicon length, and primer, probe, and amplicon sequences.

At the end of this process, 83 fusion junctions representing only 0.56% of candidate fusion junctions from Step 1 were selected in the Providence dataset. Overall, 108 fusion events consisting of 100 unique fusion junctions were identified in the two cohorts (Tables A and B). Candidate fusions were classified into 3 tiers based on the levels of supporting evidence (FIG. 1B). A total of 60 fusion junctions were selected based on cancer relevance of fused partner genes, and tested by quantitative RT-PCR assay using amplified RNA samples from selected patients harboring corresponding candidate fusions. Tier 1 fusions have the strongest sequence evidence and highest validation rate. The second tier was selected based on the combination of sequence and expression profiling. The third tier has the least evidence since they are purely predicted from gene expression patterns, thus with the lowest validation rate (FIG. 1B).

An important feature of the gene fusion detection pipeline described here is using expression profiling to select tier 2 and tier 3 candidate gene fusions with minimal sequencing data at fusion junctions. Generally, functionally important gene fusions in cancer are characterized by donor genes that are expressed at relatively high levels in non-fused state, by acceptor genes that are expressed at relatively low levels in non-fused state. The strong promoter of a donor gene may up-regulate expression of an oncogenic acceptor gene to contribute to the disease pathology (Mitelman, F. et al. (2007) The impact of translocations and gene fusions on cancer causation. Nature Reviews Cancer, 7, 233-245). Among 31 validated tier 1 fusions, only 7 (23%) fail to show an interrupted expression patterns at either donor or acceptor fusion junctions. Therefore, the filtered false negative gene fusions by expression profiling are probably low and also less likely to be less pathologically relevant. As an internal control, we performed TaqMan assays on 4 fusion candidates that had single non-duplicate reads but without interrupted expression patterns, and only one, and only ESR1→C6orf211, was validated. These two assessments suggest the false negative rate of our pipeline at Step 6 at around 25%. It has been observed fused genes tend to have high copy number variation (Supper, J. et al. (2012) Detecting and visualizing gene fusions. Methods; Kangaspeska, S. et al. (2012) Reanalysis of RNA-Sequencing Data Reveals Several Additional Fusion Genes with Multiple Isoforms. PLoS ONE, 7, e48745). Multiple normal copies of candidates with a single copy of a fused gene can mask the expression profiling of the fused genes, which can lead to the false negative fusions undetected by expression profiling approach.

Fusion transcripts may result from genomic rearrangements or transcript level rearrangements such as trans-splicing which is also biologically relevant. Another type of trans-splicing is known reverse transcriptase artifacts derived from sequence homology (Houseley, J. and Tollervey, D. (2010) Apparent Non-Canonical Trans-Splicing Is Generated by Reverse Transcriptase In Vitro. PLoS ONE, 5, e12271). Although our method cannot distinguish genomic rearrangement derived gene fusions from trans-splicing derived, we used homology sequence search between templates to remove false positive fusions potentially caused by homologous sequences introduced by mapping algorithm or RT errors. This strategy should sufficiently reduce these errors. The existence of vast amount of true negative gene fusions validated by TaqMan (Table 1) also supports the very limited RT based trans-splicing artifact in this study.

Although the gene fusion event is relatively low per patient, which could be attributed to the low quality of FFPE RNA-seq libraries, patient stratification across a breast cancer cohort based on fusion frequencies demonstrates the clinical prognostic power of fusion detection. This was further validated in the biological pathway and network analysis as fusion signature genes were highlighted in the known cancer related network (FIG. 5C). However, we observed some relapsed patients with low fusion signature index in both cohorts (FIG. 5D). It is probably due to the lack of genes from another fundamental underlying cancer mechanism which is inflammation in this fusion signature. Therefore the high genome instability level is a sufficient but not necessary condition for tumor progression, which is consistent with complexities of hallmarks of cancer (Hanahan, D. and Weinberg, R. A. (2011) Hallmarks of Cancer: The Next Generation. Cell, 144, 646-674).

Table 1 shows a summary of the results from the RT-PCR experiments of the 108 fusion events. Shown is the average CT from triplicate 10 ul TaqMan assays.

TABLE 1

| Fusion junction | Fusion genes | Avg CT |
|---|---|---|
| +chr6:152265643->+chr6:151669846 | ESR1->AKAP12 | 30.96 |
| +chr11:68080273->-chr8:41907225 | LRP5->KAT6A | 33.67 |
| -chr20:47324798->+chr20:48431545 | PREX1->SLC9A8 | 29.78 |
| -chr10:79613112->+chr10:76153899 | DLG5->ADK | 30.26 |
| -chr8:116680772->-chr8:117671219 | TRPS1->EIF3H | 31.64 |
| +chr17:37868701->-chr17:37949186 | ERBB2->IKZF3 | 31.89 |
| -chr17:62496667->-chr3:197640913 | DDX5->IQCG | 30.7 |
| +chr16:11154879->-chr16:11914154 | CLEC16A->BCAR4 | 30.56 |
| -chr2:97527316->-chr2:161131275 | SEMA4C->RBMS1 | 32.28 |
| +chr11:63449250->-chr8:41591587 | RTN3->ANK1 | 32.29 |
| +chr1:165797169->-chr1:165697358 | UCK2->TMCO1 | 35.04 |
| -chr17:35536201->+chr17:55478740 | ACACA->MSI2 | 32.47 |
| +chr10:75984349->+chr10:77795766 | ADK->C10orf11 | 31.34 |
| +chr17:61086987->-chr17:34247276 | TANC2->RDM1 | 34.47 |
| -chr20:47790732->+chr20:39690034 | STAU1->TOP1 | 35.93 |
| +chr8:42256382->+chrX:29301055 | VDAC3->IL1RAPL1 | NA |
| -chr3:12705312->-chr3:23942540 | RAF1->NKIRAS1 | 34.25 |
| +chr10:127411703->+chr10:127266780 | C10orf137->LOC100169752 | NA |
| +chr17:49354665->-chr17:35487144 | UTP18->ACACA | 32.44 |
| +chr1:36492899->-chr16:21212879 | EIF2C3->ZP2 | 35.21 |
| +chr19:52709316->+chr19:56473433 | PPP2R1A->NLRP8 | 35.17 |
| +chr13:103249553->+chr13:32890559 | TPP2->BRCA2 | 33.84 |
| +chr1:32650217->+chr5:10433706 | TXLNA->MARCH6 | NA |
| +chr8:104709524->-chr8:105436617 | RIMS2->DPYS | 34.01 |
| -chr1:235628953->-chr1:235277225 | B3GALNT2->TOMM20 | NA |
| -chr1:38155278->+chr1:39792890 | C1orf109->MACF1 | NA |
| -chr17:37840850->-chr17:37333788 | PGAP3->CACNB1 | 35.43 |
| -chr4:153332455->-chr7:152055760 | FBXW7->MLL3 | 40 |
| +chr6:41040823->+chr6:40347021 | NFYA->TDRG1 | 40 |
| +chr18:39629569->-chr18:33613800 | PIK3C3->RPRD1A | 36.52 |

TABLE 1-continued

| Fusion junction | Fusion genes | Avg CT |
|---|---|---|
| +chr19:8386587->-chr16:52118478 | RPS28->LOC100505619 | NA |
| -chr5:175837258->+chr5:175995679 | CLTB->CDHR2 | 36.65 |
| -chr5:58284320->+chr5:52218607 | PDE4D->ITGA1 | 40 |
| +chr17:5250220->+chr17:11532734 | RABEP1->DNAH9 | 30.11 |
| +chr17:5250220->+chr17:11532734 | RABEP1->DNAH9 | 34.86 |
| +chr11:36057799->-chr10:62039397 | LDLRAD3->ANK3 | NA |
| +chr12:51034635->-chr13:45379166 | DIP2B->LINC00330 | NA |
| -chr18:77710724->-chr13:45379166 | PQLC1->LINC00330 | NA |
| -chr18:77710724->-chr13:45379166 | PQLC1->LINC00330 | NA |
| +chr3:100438902->+chr3:100348442 | TFG->GPR128 | 32.84 |
| +chr3:100438902->+chr3:100348442 | TFG->GPR128 | 35.15 |
| +chr11:68133170->-chr11:62863578 | LRP5->SLC22A24 | 31.77 |
| +chr10:133761295->-chr10:91344222 | PPP2R2D->PANK1 | 34.57 |
| +chr15:99442850->+chr18:50278424 | IGF1R->DCC | 33.36 |
| -chr20:16553874->+chr20:17240885 | KIF16B->PCSK2 | 34.6 |
| +chr2:223725976->+chr2:223553063 | ACSL3->MOGAT1 | NA |
| +chr17:37866134->-chr17:37949186 | ERBB2->IKZF3 | NA |
| +chr17:37868300->-chr17:37949186 | ERBB2->IKZF3 | NA |
| -chr17:78120592->-chr21:45953806 | EIF4A3->TSPEAR | 35.02 |
| +chr12:122473333->-chr12:103872225 | BCL7A->C12orf42 | 37.82 |
| +chr6:71123405->+chr6:123038932 | FAM135A->PKIB | 37.87 |
| -chr14:103523336->-chr4:152594048 | CDC42BPB->PET112 | 40 |
| -chr14:51131897->-chr14:51245522 | SAV1->NIN | NA |
| -chr12:15370363->+chr19:547280 | RERG->GZMM | 40 |
| -chr19:35989618->-chr19:35617921 | DMKN->LGI4 | NA |
| -chr21:27326904->-chr21:30547033 | APP->C21orf7 | NA |
| +chr2:11680234->-chr2:9098771 | GREB1->MBOAT2 | 40 |
| -chr12:116450602->-chr12:39764063 | MED13L->KIF21A | NA |
| -chr15:68695257->+chr17:80417868 | ITGA11->NARF | NA |
| -chrX:122799493->+chrX:117676688 | THOC2->DOCK11 | NA |
| +chr10:31608221->+chr8:96166259 | ZEB1->PLEKHF2 | NA |
| -chr19:55610152->-chr11:1769349 | PPP1R12C->IFITM10 | 40 |
| -chr15:49059257->+chr15:90976951 | CEP152->IQGAP1 | NA |
| -chr1:169454801->-chr3:113442942 | SLC19A2->NAA50 | NA |
| +chr5:174905642->+chr5:110782384 | SFXN1->CAMK4 | 40 |
| +chr2:208435045->-chr2:98543950 | CREB1->TMEM131 | 40 |
| +chr6:152129499->+chr6:151785588 | ESR1->C6orf211 | 36.19 |
| +chr8:117779030->-chr8:117879000 | UTP23->RAD21 | 40 |
| -chr16:87760371->-chr4:3526778 | KLHDC4->LRPAP1 | NA |
| +chr7:7841374->+chr7:8043538 | LOC729852->GLCCI1 | NA |
| +chr15:80750317->-chr15:81274523 | ARNT2->MESDC2 | 40 |
| +chr8:18067689->+chr8:38099768 | NAT1->DDHD2 | NA |
| +chr9:129623018->-chr9:127818286 | ZBTB34->SCAI | 40 |
| -chrX:76907604->-chrX:83419395 | ATRX->RPS6KA6 | 40 |
| -chr9:103115054->-chr11:85742653 | TEX10->PICALM | 40 |
| +chr3:14960340->-chr4:75673359 | FGD5->BTC | NA |
| -chr3:42744071->-chr17:73328878 | HHATL->GRB2 | 40 |
| -chr6:117923167->-chr6:126359851 | GOPC->TRMT11 | NA |
| -chr9:14693227->-chr13:31037831 | ZDHHC21->HMGB1 | NA |
| +chr9:95821112->-chr8:95511734 | SUSD3->KIAA1429 | NA |
| +chr7:56032394->-chr7:82595803 | GBAS->PCLO | 40 |
| +chr6:158244478->+chr8:61531139 | SNX9->RAB2A | 40 |
| -chr10:101769595->-chr10:123954555 | DNMBP->TACC2 | 40 |
| +chr6:7108001->+chr6:7555951 | RREB1->DSP | 40 |
| +chr1:111833572->+chr7:64291829 | CHIA->ZNF138 | NA |
| -chr19:37956215->-chr7:96324203 | ZNF569->SHFM1 | NA |
| -chr17:57092971->+chr17:58786580 | TRIM37->BCAS3 | 34.66 |
| +chr22:22020420->+chr22:30064322 | PPIL2->NF2 | NA |
| -chr1:53746259->-chr1:54275419 | LRP8->TMEM48 | 40 |
| +chr17:48797192->-chr17:36047395 | LUC7L3->HNF1B | 32.13 |
| -chr8:117878825->+chr8:124968232 | RAD21->FER1L6 | 34.78 |
| +chr3:100438902->+chr3:100348442 | TFG->GPR128 | 31.03 |
| +chr17:33968994->-chr7:96115729 | AP2B1->FLJ42280 | NA |
| +chr3:100438902->+chr3:100348442 | TFG->GPR128 | 32.83 |
| +chr4:71670133->+chr4:71337932 | RUFY3->MUC7 | NA |
| +chr3:100438902->+chr3:100348442 | TFG->GPR128 | 34.68 |
| +chr3:100438902->+chr3:100348442 | TFG->GPR128 | 35.36 |
| +chr17:73521906->-chr3:131442469 | LLGL2->CPNE4 | NA |
| -chr2:97527316->+chr2:28561317 | SEMA4C->BRE | 31.08 |
| +chr6:152201906->+chr6:151669846 | ESR1->AKAP12 | 31.78 |
| -chr17:58577760->+chr17:72345323 | APPBP2->KIF19 | NA |
| +chr8:38883403->-chr8:41585524 | ADAM9->ANK1 | NA |
| -chr17:27492960->-chr17:28120955 | MYO18A->SSH2 | NA |
| +chr7:30113748->+chr9:80537261 | PLEKHA8->GNAQ | NA |
| -chr17:37453380->+chr17:44751780 | FBXL20->NSF | 31.16 |
| -chr17:57094657->+chr17:58786580 | TRIM37->BCAS3 | NA |
| -chr20:62421174->+chr20:62559688 | ZBTB46->DNAJC5 | NA |
| +chr6:152201906->+chr6:151669846 | ESR1->AKAP12 | 36.09 |

Example 5

Identification of Recurrent Gene Fusions

Heatmaps and bar plots generated in Example 3 (Step 6: Expression Profiling) were analyzed to identify gene fusions present in multiple patients from the Providence and Rush cohorts. Results are shown in Table 2, which lists the gene fusion, number of Providence patient samples positive for the gene fusion via heatmap inspection and the number of reads spanning the gene fusion junction (split reads) per Providence patient sample, number of Rush patient samples positive for the gene fusion via heatmap inspection and the number of reads spanning the gene fusion junction (split reads) per Rush sample. The symbol "†" indicates that multiple junctions were observed for the ESR1→AKAP12 gene fusion. The asterisks "*" in Table 2 indicate that the identified fusion was predicted to be recurrent because split reads were not identified in all patient samples that were positive for the gene fusion via expression profiling evaluation. For example, the data for the TFG→GPR12 gene fusion indicates that 2 patients positive for the gene fusion via heatmap inspection in Providence cohort, 1 patient in the Providence cohort that was positive for that gene fusion via expression profiling evaluation had 3 supporting split reads, and 1 patient has 0 split read. However, in the Rush cohort, of the 4 patients positive for the gene fusion via heatmap inspection, 2 patient samples had 3 split reads, 1 patient sample had 1 split read, and 1 patient sample had 0 split reads. The symbol "‡" indicates that TFG_GPR128 TFG-→GPR128 has been discovered previously Mitelman, F. et al. (2012) Mitelman Database of Chromosome Aberrations and Gene Fusions in Cancer; Asmann, Y. W. et al. (2012) Detection of Redundant Fusion Transcripts as Biomarkers or Disease-Specific Therapeutic Targets in Breast Cancer. *Cancer Res*, 72, 1921-1928. The symbol "--" in various samples from the Rush cohort indicates that there were no samples positive for the indicated gene fusion and there were no split reads supporting the gene fusion. Accordingly, for those gene fusions, recurrence was observed among the Providence patient samples only.

TABLE 2

| Fusion Gene | No. of Patient Samples (Providence) and No. of Split Reads Per Patient Sample | No. of Patient Samples (Rush) and No. of Split Reads Per Patient Sample |
|---|---|---|
| ESR1_AKAP12† | 1 sample total: 41 split reads (positive via RT-PCR) | 2 samples total 1 patient: 5 split reads (positive via RT-PCR) 1 patient: 1 split read (positive via RT-PCR) |
| TFG_GPR128*‡ | 2 samples total 1 sample: 3 split reads (positive via RT-PCR) | 4 samples total 2 samples: 3 split reads |

TABLE 2-continued

| Fusion Gene | No. of Patient Samples (Providence) and No. of Split Reads Per Patient Sample | No. of Patient Samples (Rush) and No. of Split Reads Per Patient Sample |
|---|---|---|
| | 1 sample: 0 split reads (positive by RT-PCR) | (positive via RT-PCR) 1 sample: 1 split read (positive via RT-PCR) 1 sample: 0 split reads (positive via RT-PCR) |
| RABEP1_DNAH9* | 2 samples total 1 sample: 2 reads (positive via RT-PCR) 1 sample: 0 reads (positive via RT-PCR) | — |
| EIF2C3_ZP2* | 3 samples total 1 sample: 4 split reads (positive via RT-PCR) 2 samples: 0 split reads (negative via RT-PCT) | — |
| NFYA_TDRG1* | 10 samples total 1 sample: 2 split reads (negative via RT-PCT) 9 samples: 0 split reads (negative via RT-PCT) | — |
| KIF16B_PCSK2* | 3 samples total 1 sample: 1 split read (positive via RT-PCT) 2 samples: 0 split reads (negative via RT-PCT) | — |
| BCL7A_C12orf42 | 3 samples total 1 sample: 1 split read (positive via RT-PCT) 2 samples: 0 split reads (negative via RT-PCT) | — |
| RERG_GZMM* | 4 samples total 1 sample: 1 split read (negative via RT-PCT) 3 samples: 0 split reads (negative via RT-PCT) | — |
| RAF1_NKIRAS1* | 3 samples total 1 sample: 6 split reads (positive via RT-PCR) 2 samples: 0 split reads (negative via RT-PCT) | — |
| UTP23_RAD21* | 4 samples total 1 sample: 2 split reads (negative via RT-PCT) 3 samples 0 split reads (negative via RT-PCT) | — |
| LRP5_SLC22A24* | 2 samples total 1 sample: 2 split reads (RT-PCR results unavailable) 1 sample: 0 split reads (RT-PCR results unavailable) | — |
| LRP5_KAT6A* | 3 samples total 1 sample: 26 split reads (positive via RT-PCT) 2 samples: 0 split reads (negative via RT-PCT) | — |
| PREX1_SLC9A8* | 2 samples total 1 sample: 22 split reads (RT-PCR results unavailable) 1 sample: 0 split reads (RT-PCR results unavailable) | — |
| PPP2R1A_NLRP8* | 2 samples total 1 sample: 2 split reads (positive via RT-PCR) 1 sample: 0 split reads (negative via RT-PCR) | — |
| PQLC1_LINC00330 | 2 samples total each sample: 1 split read (RT-PCR results unavailable) | — |

The list of candidate gene fusions was also analyzed to identify recurrent gene fusions within a given sample in order to identify genes that may be hotspots for chromosomal aberrations that cause gene fusions. Table 3 shows gene fusions that were recurrent in a single sample.

TABLE 3

| Gene Fusion | No. of Gene Fusion Junctions Identified in a Single Patient Sample (Providence) and No. of Split Reads Per Junction | No. of Patient Samples (Rush) and No. of Split Reads Per Patient Sample |
|---|---|---|
| ERBB2_IKZF3 | 1 sample total (3 fusion junctions within that sample) 1 fusion junction: 79 split reads 1 fusion junction: 6 split reads 1 fusion junction: 4 split reads | — |
| TRIM37_BCAS3 | — | 1 sample total (2 fusion junctions within that sample) 1 fusion junction: 19 split reads 1 fusion junction: 1 split read |
| ESR1 (involved in two fusion junctions) | 1 sample total (two fusion junctions involving ESR1) | — |
| ESR1_AKAP12 | ESR1_AKAP12: 41 split reads | |
| ESR1_C6orf211 | ESR1_C6orf211: 4 split reads | |

The list of candidate gene fusions was further analyzed to identify recurrent gene fusions present in different samples (either within a single or cohort or between cohorts) in order to identify genes that may be hotspots for chromosomal aberrations that cause gene fusions. Results are shown in Table 4.

spliced junctions, Steps 1-3 of Example 3 were performed using the Providence cohort samples. Novel distant splice junctions from the candidate gene fusions resulting from Step 3 of Example 3 were annotated using the Ensembl Reference (Biomart). First, Ensemble was used to create a canonical splice junction dictionary to enable identification

TABLE 4

| Gene involved in Gene Fusion | No. Patient Samples Positive for the Gene Fusion (Providence) and No. Split Reads per Junction | No. Patient Samples Positive for the Gene Fusion (Rush) and No. Split Reads per Junction |
|---|---|---|
| ACACA | 1 sample: UTP18_ACACA<br>1 split read<br>1 sample: ACACA_MSI2<br>9 split reads | — |
| ADK | 1 sample: DLG5_ADK<br>17 split reads<br>1 sample: ADK_C10orf11<br>6 split reads | — |
| ANK1 | 1 sample: RTN3_ANK1<br>7 split reads | 1 sample: ADAM9_ANK1<br>7 split reads |
| SEMA4C | 1 sample SEMA4C_RBMS1<br>9 split reads | 1 sample SEMA4C_BRE<br>26 split reads |
| RAD21 | 1 sample: UTP23_RAD21<br>2 split reads | 1 sample: RAD21_FER1L6<br>2 split reads |
| LINC00330 | 1 sample: DIP2B_LINC00330<br>1 split read<br>2 samples: PQLC1_LINC00330<br>Each sample: 1 split read | — |

Also, multiple recurrent partners fused to different partners were found within the two cohorts. In the Providence sample harboring ESR1→AKAP12, another fusion ESR1→C6orf211 was found and validated, it suggests multiple copies of ESR1 existed and they were fused to different acceptors. LRP5 was also found and validated to be fused to different acceptors KAT6A and SLC22A24 in the same patient. However ADK was found and validated to be an acceptor in the fusion DLG5→ADK in one patient, and a donor in the fusion ADK→C10orf11 in another patient. Similarly, the gene ACACA was also found and validated as the donor of ACACA→MSI2 in one patient, and the acceptor of UTP18→ACACA in another patient. We further searched the Mitelman fusion database with all 184 unique fusion partners including donors and acceptors from the final 108 fusion list, and 29 partners were found fused to various different partners in the database (Mitelman, F. et al. (2012) Mitelman Database of Chromosome Aberrations and Gene Fusions in Cancer). Among them, ACACA, BCAS3, DDX5, FBXL20, IKZF3, RAF1, TFG and TRPS1 were fused to more than one partner in the database. These observations suggest fusion events are unlikely random although they appear to be rare in solid tumors.

Example 7

Identifying Alternative Spliced Junctions

An overview of the method for identifying alternative spliced junctions is shown in FIG. 1. To identify alternative spliced junctions, Steps 1-3 of Example 3 were performed using the Providence cohort samples. Novel distant splice junctions from the candidate gene fusions resulting from Step 3 of Example 3 were annotated using the Ensembl Reference (Biomart). First, Ensemble was used to create a canonical splice junction dictionary to enable identification of novel distant spliced junctions. 98% of the distant spliced junctions were considered novel. Next, the type of alternative spliced junction was classified as involving a novel donor (0.3%), a novel acceptor (0.42%), a novel donor and acceptor (1.27%), exon shuffling (96.37%), exon skipping (0.92%), or an unknown case (0.71%). 74.7% of the distant spliced junctions remained after application of a same gene filter and 19.6% of the distant spliced junctions remained after application of a minimum non-duplicate read filter. Finally, clinical information regarding breast cancer recurrence in the Providence cohort was applied to identify alternative spliced junctions that correlated with cancer recurrence. 1.8% of the junctions passed Fisher's Test of a p-value less than 0.05.

Six candidate alternative splicing junctions were identified using the above method. The candidate alternative splicing junctions are shown in Table 5. Table 5 shows the gene symbol, the alternative spliced junction within the gene, Fisher's p value, the non-recurrent ratio, the recurrent ratio, the non-recurrence sample count, the recurrence sample count, and the splice type identified by the method described herein. Alternative spliced junctions in UBXN7, SOX5, KIAA0368, PIKC3C, and DAP3 correlated with non-recurrence of breast cancer whereas an alternative spliced junction MITD1 correlated with recurrence of breast cancer. Furthermore, investigation of the alternative spliced junction in PIKC3 predicts a fusion protein with a junction at amino acids 701 and 887 (data not shown).

TABLE 5

| Gene Symbol | Junction | Fisher P Value | Non-Recurrent Ratio | Recurrent Ratio | Non-Recurrence Sample Count | Recurrence Sample Count | Splice Type |
|---|---|---|---|---|---|---|---|
| UBXN7 | −chr3:196118684_−chr3:196129890 | 0.0091 | 26.5% | 3.7% | 31 of 117 | 1 of 27 | Exon Shuffle |
| SOX5 | −chr12:24366277_−chr12:24048958 | 0.0095 | 25.6% | 3.7% | 30 of 117 | 1 of 27 | Unknown |
| MITD1 | −chr2:99786013_−chr2:99787892 | 0.0123 | 14.5% | 37.0% | 17 of 117 | 10 of 27 | Exon Shuffle |

TABLE 5-continued

| Gene Symbol | Junction | Fisher P Value | Non-Recurrent Ratio | Recurrent Ratio | Non-Recurrence Sample Count | Recurrence Sample Count | Splice Type |
|---|---|---|---|---|---|---|---|
| KIAA0368 | −chr9:114148657_−chr9:114154104 | 0.0134 | 41.0% | 14.8% | 48 of 117 | 4 of 27 | Exon Shuffle |
| PIK3C3 | +chr18:39629569_+chr18:39623697 | 0.0276 | 41.9% | 18.5% | 49 of 117 | 5 of 27 | Exon Shuffle |
| DAP3 | +chr1:155695810_+chr1:155695173 | 0.0464 | 20.5% | 3.7% | 24 of 117 | 1 of 27 | Exon Shuffle |

Example 8

Validating Alternative Splice Junctions

Validation of the alternative splice junctions is determined using quantitative RT-PCR. Quantitative RT-PCR analysis using TaqMan® RT PCR is used to investigate the six alternative spliced junctions identified in Example 7. Reverse transcription is carried out using the OmniPure RT kit (Qiagen). Reverse transcription is performed by combining random hexamers and gene-specific primers at 37° C. for 1 hour.

Fluorogenic probes are dual-labeled with 5'-FAM as a reporter and 3'-BHQ-2 as a quencher. Primers and probes are designed using the Primer3 program (http://frodo.wi.mit.edu/). In some cases, primer and probe sequences are optimized manually to ensure optimal performance of the TaqMan® assay design for FFPE samples. The TaqMan® assay designs are manually optimized to select an amplicon size less than 100 bases in length and to enable the probe to approximately span the alternative spliced junction. No template (i.e., water) is used as a negative control.

Results from quantitative RT-PCR are obtained and analyzed to investigate the validity of the alternative spliced junctions identified using the bioinformatics approach.

Example 9

Increased Fusion Events are Associated with Poor Tumor Prognosis

The average fusion events per patient across Providence and Rush cohorts are 0.63 and 0.29 respectively, far less than the average of 4.2 fusions in fresh frozen breast cancer biopsies (Robinson, D. R. et al. (2011) Functionally recurrent rearrangements of the MAST kinase and Notch gene families in breast cancer. *Nature Medicine*, 17, 1646-1651; Asmann, Y. W. et al. (2012) Detection of Redundant Fusion Transcripts as Biomarkers or Disease-Specific Therapeutic Targets in Breast Cancer. *Cancer Res*, 72, 1921-1928). This difference can reasonably be attributed to the poor quality of FFPE RNAs. This is born out in the Rush and Providence data sets, the former having older archival ages therefore poorer quality RNA and yielding a far fewer identified gene fusions (FIG. 5A).

Within each patient cohort we investigated whether the number of fusion events detected within individual tumors related to the likelihood of disease recurrence. We thus stratified patients according to the numbers of fusion events within each cohort (FIG. 5A). Since not all fusions have tested by TaqMan assay, the final fusion list (Tables A and B) was used in stratification regardless of validation results. In view of the limited number of fusions detected in the Rush dataset we evaluated just 2 categories: fusion detected or not detected, whereas in the Providence dataset we evaluated four abundance categories. The 8 patients with greater than two fusions (subsequently referred to as multiple fusions) in Providence have statistically significant increased recurrence risk compared to patients from three other groups (FIG. 5B). In the Rush dataset disease recurred at an increased rate among patients with detected fusions, although this relationship doesn't not quite achieve statistical significance cutoff. To check whether minimizing the block age effect improves this relationship, we resorted to subset patients into either upper three or lower three quantiles of the block age since sizable patients with comparable block age were difficult to obtain considering the small cohort size. The separations of patients with fusions from patients without fusions were significantly improved in both subsets of Rush (FIG. 6). The similar results were observed with Providence block age subsets. Interestingly, we also observed enrichment of estrogen receptor negative (ER−) patients in Providence multiple fusion group and Rush fusion group (FIG. 3A), consistent with the well-known poor prognosis of ER− patients (DeSombre and Jensen, 1980) and the published evidence of increased chromosome instability levels in ER− tumors (Endesfelder et al., 2011).

In order to assess the biological significance of the fusion frequency, we identified genes differentially expressed between the multiple fusion group versus no fusion group in the Providence cohort. Since ER status can effect gene expression greatly, an additive model of edgeR using ER status as background was applied to remove ER effect in identifying genes related to fusion frequency. We took extra cautions to examine the pairwise comparisons between any Providence fusion frequency groups, and confirmed the differentially expressed genes between multiple fusion samples versus no fusion samples are specific to this comparison, which achieved maximum differentially expression among all comparisons tested (Table 6). Accordingly, Table 6 shows pairwise differentially expressed (DE) gene analysis between sample categories by fusion number in Providence show differentially expressed fusion gene signatures are specific to the comparison of multiple fusion samples to no fusion samples.

TABLE 6

| Differentially expressed gene # up/down | Sample category by fusion number | | |
|---|---|---|---|
| | 2 fusions | 1 fusion | 0 fusion |
| Multiple fusions | 4/2 (2) | 49/2 (42) | 128/6 |
| 2 fusions | NA | 9/0 (0) | 31/0 (0) |
| 1 fusion | NA | NA | 29/7 (0) |

Note:
The additive model of edgeR was used with ER status as background with FDR <0.05 for each pairwise DE analysis. The up-regulated and down-regulated gene numbers are shown. The numbers in parenthesis are the overlapping genes with DE genes of multiple fusion samples versus no fusion samples.

Figure 7A:
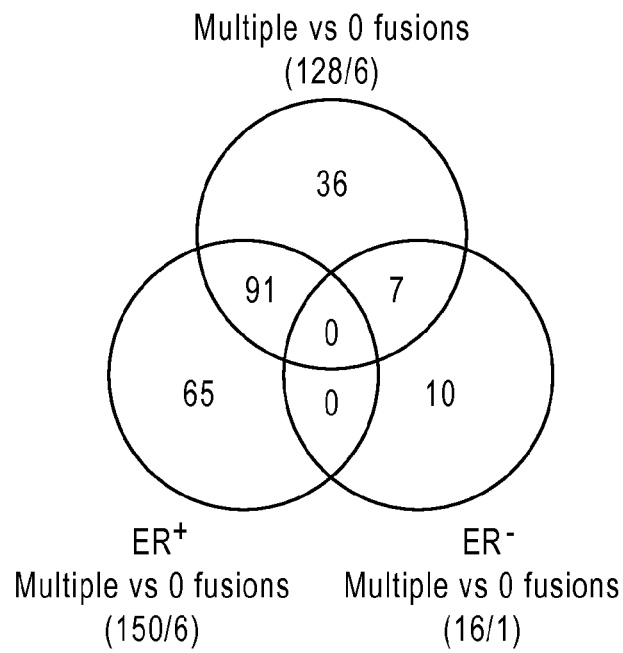
Figure 7B:
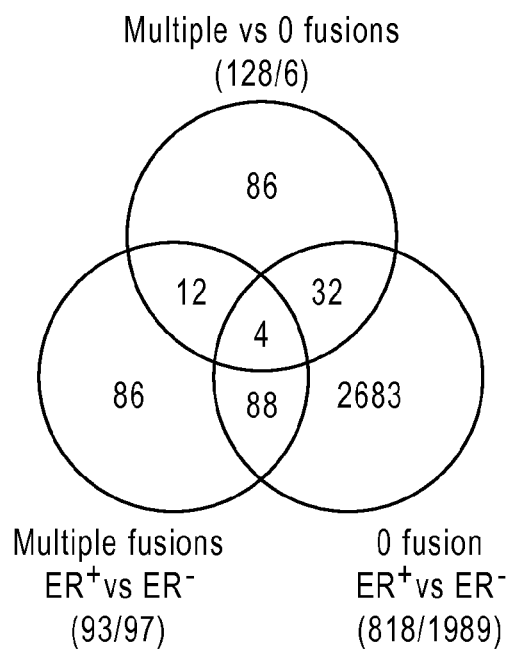

Both multiple fusion samples and no fusion samples were also segregated according to ER status, and the overlapped genes between each category were compared (FIG. 7). Although ER+ samples contribute more to the differentially expressed genes between multiple fusion samples versus no fusion samples due to the majority of Providence samples are ER+ (FIG. 7A), the overlapped fusion differentially expressed genes with genes differentially expressed solely due to ER status are reasonably small (FIG. 7B). These investigations showed evidence that the 134 differentially expressed genes obtained by the edgeR additive model reflect the difference by fusion frequency rather than by ER status. Then the total 134 genes were uploaded to Reactome FI (functional interaction) database via Cytoscape Plugin (G. Wu et al., 2010) to perform network clustering. As shown in FIG. 5C, 84 up-regulated genes in multiple fusion group versus no fusion group formed a network, which we termed as the fusion gene signature (Table 7). We show that expression of the fusion gene signature in Providence tumors was also significantly greater in patients with multiple fusions than in patients with 1 or 2 detected fusions (FIG. 5D). Further, in the Rush cohort the expression of this signature is significantly greater in tumors with identified fusions (FIG. 5D).

These fusion signature genes were clustered into five related functional steps (FIG. 5C). Strikingly, these functions are all cancer epithelial cells related, and are the characteristics of prominent pathological hallmarks of cancers (Hanahan, D. and Weinberg, R. A. (2011) Hallmarks of Cancer: The Next Generation. Cell, 144, 646-674). The underlying mechanism of these cancer hallmarks is the cancer enabling characteristic, genome instability, which can lead to chromosome rearrangement and therefore gene fusions. Thus the relationship between gene fusion frequency reflecting genome stability level and tumor prognosis is supported by the current understanding of tumor progression.

TABLE 7

| Gene symbol | Entrez gene ID | Gene description | Step # | Function |
|---|---|---|---|---|
| AP4E1 | 23431 | adaptor-related protein complex 4, epsilon 1 subunit | 0 | Mitogenic signaling |
| ATG5 | 9474 | autophagy related 5 | 0 | Mitogenic signaling |
| BSG | 682 | basigin (Ok blood group) | 0 | Mitogenic signaling |
| CAND1 | 55832 | cullin-associated and neddylation-dissociated 1 | 0 | Mitogenic signaling |
| CCT2 | 10576 | chaperonin containing TCP1, subunit 2 (beta) | 0 | Mitogenic signaling |
| CD24 | 100133941 | CD24 molecule | 0 | Mitogenic signaling |
| CIB1 | 10519 | calcium and integrin binding 1 (calmyrin) | 0 | Mitogenic signaling |
| CLTC | 1213 | clathrin, heavy chain (Hc) | 0 | Mitogenic signaling |
| CPT1A | 1374 | carnitine palmitoyltransferase 1A (liver) | 0 | Mitogenic signaling |
| DCC | 1630 | deleted in colorectal carcinoma | 0 | Mitogenic signaling |
| FHL2 | 2274 | four and a half LIM domains 2 | 0 | Mitogenic signaling |
| GALNT1 | 2589 | UDP-N-acetyl-alpha-D-galactosamine:polypeptide N-acetylgalactosaminyltransferase 1 (GalNAc-T1) | 0 | Mitogenic signaling |
| GNB5 | 10681 | guanine nucleotide binding protein (G protein), beta 5 | 0 | Mitogenic signaling |
| HPGD | 3248 | hydroxyprostaglandin dehydrogenase 15-(NAD) | 0 | Mitogenic signaling |
| IGF1R | 3480 | insulin-like growth factor 1 receptor | 0 | Mitogenic signaling |
| MAPK6 | 5597 | mitogen-activated protein kinase 6 | 0 | Mitogenic signaling |
| MST4 | 51765 | serine/threonine protein kinase MST4 | 0 | Mitogenic signaling |
| PEX13 | 5194 | peroxisomal biogenesis factor 13 | 0 | Mitogenic signaling |
| PIP4K2C | 79837 | phosphatidylinositol-5-phosphate 4-kinase, type II, gamma | 0 | Mitogenic signaling |
| PRDX1 | 5052 | peroxiredoxin 1 | 0 | Mitogenic signaling |
| PTPRF | 5792 | protein tyrosine phosphatase, receptor type, F | 0 | Mitogenic signaling |
| TMOD2 | 29767 | tropomodulin 2 (neuronal) | 0 | Mitogenic signaling |
| TUBB3 | 10381 | tubulin, beta 3 class III | 0 | Mitogenic signaling |
| USP8 | 9101 | ubiquitin specific peptidase 8 | 0 | Mitogenic signaling |
| ATP5B | 506 | ATP synthase, H+ transporting, mitochondrial F1 complex, beta polypeptide | 1 | Energy metabolism |
| BRF2 | 55290 | BRF2, subunit of RNA polymerase III transcription initiation factor, BRF1-like | 1 | Energy metabolism |
| CDC20 | 991 | cell division cycle 20 homolog (S. cerevisiae) | 1 | Energy metabolism |
| CDCA8 | 55143 | cell division cycle associated 8 | 1 | Energy metabolism |
| COX6B1 | 1340 | cytochrome c oxidase subunit VIb polypeptide 1 (ubiquitous) | 1 | Energy metabolism |
| G6PD | 2539 | glucose-6-phosphate dehydrogenase | 1 | Energy metabolism |

TABLE 7-continued

| Gene symbol | Entrez gene ID | Gene description | Step # | Function |
|---|---|---|---|---|
| IDH2 | 3418 | isocitrate dehydrogenase 2 (NADP+), mitochondrial | 1 | Energy metabolism |
| LEO1 | 123169 | Leo1, Paf1/RNA polymerase II complex component, homolog (S. cerevisiae) | 1 | Energy metabolism |
| MAT1A | 4143 | methionine adenosyltransferase I, alpha | 1 | Energy metabolism |
| MED13 | 9969 | mediator complex subunit 13 | 1 | Energy metabolism |
| PGK1 | 5230 | phosphoglycerate kinase 1 | 1 | Energy metabolism |
| PSMB2 | 5690 | proteasome (prosome, macropain) subunit, beta type, 2 | 1 | Energy metabolism |
| PSMC4 | 5704 | proteasome (prosome, macropain) 26S subunit, ATPase, 4 | 1 | Energy metabolism |
| SMARCD2 | 6603 | SWI/SNF related, matrix associated, actin dependent regulator of chromatin, subfamily d, member 2 | 1 | Energy metabolism |
| SMG8 | 55181 | smg-8 homolog, nonsense mediated mRNA decay factor (C. elegans) | 1 | Energy metabolism |
| SNRPB2 | 6629 | small nuclear ribonucleoprotein polypeptide B | 1 | Energy metabolism |
| TFCP2L1 | 29842 | transcription factor CP2-like 1 | 1 | Energy metabolism |
| UBB | 7314 | ubiquitin B | 1 | Energy metabolism |
| VPS4B | 9525 | vacuolar protein sorting 4 homolog B (S. cerevisiae) | 1 | Energy metabolism |
| CFL1 | 1072 | cofilin 1 (non-muscle) | 2 | Cell motility |
| HMGCR | 3156 | 3-hydroxy-3-methylglutaryl-CoA reductase | 2 | Cell motility |
| IPP | 3652 | intracisternal A particle-promoted polypeptide | 2 | Cell motility |
| MYO5A | 4644 | myosin VA (heavy chain 12, myoxin) | 2 | Cell motility |
| MYO5C | 55930 | myosin VC | 2 | Cell motility |
| PAK4 | 10298 | p21 protein (Cdc42/Rac)-activated kinase 4 | 2 | Cell motility |
| PPP1R1B | 84152 | protein phosphatase 1, regulatory (inhibitor) subunit 1B | 2 | Cell motility |
| RAB11FIP1 | 80223 | RAB11 family interacting protein 1 (class I) | 2 | Cell motility |
| SEC23B | 10483 | Sec23 homolog B (S. cerevisiae) | 2 | Cell motility |
| SLC6A9 | 6536 | solute carrier family 6 (neurotransmitter transporter, glycine), member 9 | 2 | Cell motility |
| TMED2 | 10959 | transmembrane emp24 domain trafficking protein 2 | 2 | Cell motility |
| TMED9 | 54732 | transmembrane emp24 protein transport domain containing 9 | 2 | Cell motility |
| TMOD3 | 29766 | tropomodulin 3 (ubiquitous) | 2 | Cell motility |
| TRPM7 | 54822 | transient receptor potential cation channel, subfamily M, member 7 | 2 | Cell motility |
| ARPP19 | 10776 | cAMP-regulated phosphoprotein, 19 kDa | 3 | Cell cycle |
| BRIP1 | 83990 | BRCA1 interacting protein C-terminal helicase 1 | 3 | Cell cycle |
| EIF3I | 8668 | eukaryotic translation initiation factor 3, subunit I | 3 | Cell cycle |
| GABPB1 | 2553 | GA binding protein transcription factor, beta subunit 1 | 3 | Cell cycle |
| GINS2 | 51659 | GINS complex subunit 2 (Psf2 homolog) | 3 | Cell cycle |
| H2AFZ | 3015 | H2A histone family, member Z | 3 | Cell cycle |
| KPNA2 | 3838 | karyopherin alpha 2 (RAG cohort 1, importin alpha 1) | 3 | Cell cycle |
| MBD2 | 8932 | methyl-CpG binding domain protein 2 | 3 | Cell cycle |
| OCLN | 100506658 | occludin | 3 | Cell cycle |
| POLI | 11201 | polymerase (DNA directed) iota | 3 | Cell cycle |
| QRSL1 | 55278 | glutaminyl-tRNA synthase (glutamine-hydrolyzing)-like 1 | 3 | Cell cycle |
| RRM2 | 6241 | ribonucleotide reductase M2 | 3 | Cell cycle |
| ATP6V0B | 533 | ATPase, H+ transporting, lysosomal 21 kDa, V0 subunit b | 4 | DNA damage response |
| DCAF7 | 10238 | DDB1 and CUL4 associated factor 7 | 4 | DNA damage response |

TABLE 7-continued

| Gene symbol | Entrez gene ID | Gene description | Step # | Function |
|---|---|---|---|---|
| HSP90B1 | 7184 | heat shock protein 90 kDa beta (Grp94), member 1 | 4 | DNA damage response |
| LDHA | 3939 | lactate dehydrogenase A | 4 | DNA damage response |
| LOXL4 | 84171 | lysyl oxidase-like 4 | 4 | DNA damage response |
| MDM2 | 4193 | Mdm2, p53 E3 ubiquitin protein ligase homolog (mouse) | 4 | DNA damage response |
| NQO1 | 1728 | NAD(P)H dehydrogenase, quinone 1 | 4 | DNA damage response |
| P4HA1 | 5033 | prolyl 4-hydroxylase, alpha polypeptide I | 4 | DNA damage response |
| PDIA6 | 10130 | protein disulfide isomerase family A, member 6 | 4 | DNA damage response |
| SLC2A1 | 6513 | solute carrier family 2 (facilitated glucose transporter), member 1 | 4 | DNA damage response |
| TK1 | 7083 | thymidine kinase 1, soluble | 4 | DNA damage response |
| AKR1A1 | 10327 | aldo-keto reductase family 1, member A1 (aldehyde reductase) | 5 | |
| SHMT2 | 6472 | serine hydroxymethyltransferase 2 (mitochondrial) | 5 | |
| BCAP31 | 10134 | B-cell receptor-associated protein 31 | 6 | |
| CANX | 821 | calnexin | 6 | |

Methods Regarding RNA-Seq Expression Analysis

The differentially expressed genes were analyzed by edgeR (Robinson, M. D. et al. (2010) edgeR: a Bioconductor package for differential expression analysis of digital gene expression data. *Bioinformatics*, 26, 139-140) based on base count tables tallied from GSNAP mapping results. For the comparison of Providence multiple fusions versus no fusion samples, the low expression filter requires minimum 8 samples with at least 250 base counts which equivalent to 5 reads, and the Cox-Reid profile-adjusted likelihood method was used to estimate mean-variance relationships. Due to the strong influence of ER status on gene expression profiling, the additive model of edgeR was used to get differentially expressed genes between multiple fusion samples versus no fusion samples adjusting for differences between ER positive and negative status. The false discovery rate of differentially expressed genes was set at 0.05 of Bonferroni-Holm method adjusted p values.

The differentially expressed genes were mapped to a cancer focused protein-protein interaction database, Reactome FI database as instructed by the Reactome FIs Cytoscape plugin. The network was clustered by a built-in spectral partition based clustering algorithm, and nodes in different network modules (FIG. 5C).

Example 10

Alternative Methods of Expression Profiling to Identify Gene Fusions

In other experiments, based on the expression profiling, the acceptor exon boundary is identified precisely. A chimera database is built with that fixed on the right hand of the sequence; the left part of the sequence is one of the 300,000 exons from RefSeq (all 20,000+ genes). Mapping each read against the chimera database potentially identifies the donor exon/gene.

Example 11

Identification of ESR1-AKAP12 Fusion Using Outlier Expression

In a separate set of experiments, outlier expression analysis was used to identify an ESR1-AKAP12 fusion in a patient sample from the Rush cohort. In summary, the fusion between ESR1 and AKAP12 in the Rush cohort was identified by a combination of identifying the expression outlier of AKAP12 from the entire cohort followed by the sequence comparison for AKAP12 and ESR1.

First, expression analysis was used to identify the original read counts for the entire Rush cohort. The original read counts were normalized by Q3 then log 2 transformed to assess the expression level for each gene. AKAP12 gene expression was plotted in a histogram to identify the expression outlier(s), defined by the 3 standard deviation of the mean level. FIG. 8 shows the histogram of AKAP12 counts for the patients in the Rush cohort. The expression outlier is circled.

Second, reads were investigated to identify those spanning the fusion between ESR1 and AKAP12. All of the reads from the above patient were mapped against the human genome by Bowtie. The fusion reads were in the unmapped category. Using ESR1 and AKAP12 as the two separate targets, the unmapped reads were aligned against them. The reads which could be aligned both to ESR1 and AKAP12 were then identified. This process identified the following read maps to the junction between ESR1 and AKAP12 at +chr6:152201906(ESR1)→+chr6:151669846(AKAP12).

All references cited throughout the disclosure, including the examples, are hereby expressly incorporated by reference for their entire disclosure.

While the present invention has been described with reference to what is considered to be specific embodiments, it is to be understood that the invention is not so limited. To the contrary, the invention is intended to cover various modifications and equivalents included within the spirit and scope of the appended claims.

TABLE A

| Cohort | Fusion junction | Fusion genes | COSMIC gene | Donor HUGO gene symbol | Donor Entrez gene ID | Donor gene type | Donor gene description | Accept or Entrez gene ID | Accept or gene type | Accept or HUGO gene symbol | Accept or gene description |
|---|---|---|---|---|---|---|---|---|---|---|---|
| Providence | +chr6:152265643->+chr6:151669846 | ESR1-> AKAP12 | ESR1 | ESR1 | 2099 | protein-coding | estrogen receptor 1 | 9590 | protein-coding | AKAP12 | A kinase (PRKA) anchor protein 12 |
| Providence | +chr11:68880273->+chr8:41907225 | LRP5-> KAT6A | LRP5 | LRP5 | 4041 | protein-coding | low density lipoprotein receptor-related protein 5 | 7994 | protein-coding | KAT6A | K(lysine) acetyl-transferase 6A |
| Providence | -chr20:47324798->+chr20:48431545 | PREX1-> SLC9A8 | PREX1 | PREX1 | 57580 | protein-coding | phosphatidylinositol-3,4,5-trisphosphate-dependent Rac exchange factor 1 | 23315 | protein-coding | SLC9A8 | solute carrier family 9, subfamily A (NHE8, cation proton antiporter 8), member 8 |
| Providence | -chr10:79613112->+chr10:76153899 | DLG5-> ADK | DLG5 | DLG5 | 9231 | protein-coding | discs, large homolog 5 (Drosophila) | 132 | protein-coding | ADK | adenosine kinase |
| Providence | -chr8:116680772->-chr8:117671219 | TRPS1-> EIF3H | TRPS1 | TRPS1 | 7227 | protein-coding | trichorhino-phalangeal syndrome I | 8667 | protein-coding | EIF3H | eukaryotic translation initiation factor 3, subunit H |
| Providence | +chr17:37868701->-chr17:37949186 | ERBB2-> IKZF3 | ERBB2 | ERBB2 | 2064 | protein-coding | v-erb-b2 erythroblastic leukemia viral oncogene homolog 2, neuro/glioblastoma derived oncogene homolog (avian) | 22806 | protein-coding | IKZF3 | IKAROS family zinc finger 3 (Aiolos) |
| Providence | -chr17:62496667->-chr3:197640913 | DDX5-> IQCG | DDX5 | DDX5 | 1655 | protein-coding | DEAD (Asp-Glu-Ala-Asp) (SEQ ID NO: 357) box helicase 5 | 84223 | protein-coding | IQCG | IQ motif containing G |
| Providence | +chr16:11154879->-chr16:11914154 | CLEC16A-> BCAR4 | CLEC16A | CLEC16A | 23274 | protein-coding | C-type lectin domain family 16, member A | 400500 | miscRNA | BCAR4 | breast cancer anti-estrogen resistance 4 (non-protein coding) |
| Providence | -chr2:97527316->-chr2:161131275 | SEMA4C-> RBMS1 | SEMA4C | SEMA4C | 54910 | protein-coding | sema domain, immunoglobulin domain (Ig), transmembrane domain (TM) and short cytoplasmic domain, (semaphorin) 4C | 5937 | protein-coding | RBMS1 | RNA binding motif, single stranded interacting protein 1 |
| Providence | +chr7:63449250->-chr8:41591587 | RTN3-> ANK1 | RTN3 | RTN3 | 10313 | protein-coding | reticulon 3 | 286 | protein-coding | ANK1 | ankyrin 1, erythrocytic |
| Providence | +chr1:165797169->-chr1:165697358 | UCK2-> TMCO1 | UCK2 | UCK2 | 7371 | protein-coding | uridine-cytidine kinase 2 | 54499 | protein-coding | TMCO1 | transmembrane and coiled-coil domains 1 |
| Providence | -chr17:35536201->+chr17:55478740 | ACACA-> MSI2 | ACACA | ACACA | 31 | protein-coding | acetyl-CoA carboxylase alpha | 124540 | protein-coding | MSI2 | musashi homolog 2 (Drosophila) |

TABLE A-continued

| Cohort | Fusion junction | Fusion genes | COSMIC gene | Donor Entrez gene ID | Donor gene type | Donor HUGO gene symbol | Donor gene description | Accept or Entrez gene ID | Accept or gene type | Accept or HUGO gene symbol | Accept or gene description |
|---|---|---|---|---|---|---|---|---|---|---|---|
| Providence | +chr10:75984349->+chr10:77795766 | ADK-> C10orf11 | | 132 | protein-coding | ADK | adenosine kinase | 83938 | protein-coding | C10orf11 | chromosome 10 open reading frame 11 |
| Providence | +chr17:61086987->+chr17:34247276 | TANC2-> RDM1 | TANC2 | 26115 | protein-coding | TANC2 | tetratricopeptide repeat, ankyrin repeat and coiled-coil containing 2 | 201299 | protein-coding | RDM1 | RAD52 motif 1 |
| Providence | -chr20:47790732->+chr20:39690034 | STAU1-> TOP1 | STAU1 | 6780 | protein-coding | STAU1 | staufen, RNA binding protein, homolog 1 (Drosophila) | 7150 | protein-coding | TOP1 | topoisomerase (DNA) I |
| Providence | +chr4:42256382->+chrX:29301055 | VDAC3-> IL1RAPL1 | VDAC3 | 7419 | protein-coding | VDAC3 | voltage-dependent anion channel 3 | 11141 | protein-coding | IL1RAPL1 | interleukin 1 receptor accessory protein-like 1 |
| Providence | -chr3:12705312->-chr3:23942540 | RAF1-> NKIRAS1 | RAF1 | 5894 | protein-coding | RAF1 | v-raf-1 murine leukemia viral oncogene homolog 1 | 28512 | protein-coding | NKIRAS1 | NFKB inhibitor interacting Ras-like 1 |
| Providence | +chr10:127411703->+chr10:127266780 | C10orf137-> LOC100169752 | C10orf137 | 26098 | protein-coding | C10orf137 | chromosome 10 open reading frame 137 | 100169752 | miscRNA | LOC100169752 | uncharacterized LOC100169752 |
| Providence | +chr17:49354665->-chr17:35487144 | UTP18-> ACACA | UTP18_ACACA | 51096 | protein-coding | UTP18 | UTP18 small subunit (SSU) processome component homolog (yeast) | 31 | protein-coding | ACACA | acetyl-CoA carboxylase alpha |
| Providence | +chr1:36492899->-chr16:21212879 | EIF2C3-> ZP2 | EIF2C3_ZP2 | 192669 | protein-coding | EIF2C3 | eukaryotic translation initiation factor 2C, 3 | 7783 | protein-coding | ZP2 | zona pellucida glycoprotein 2 (sperm receptor) |
| Providence | +chr19:52709316->+chr19:56473433 | PPP2R1A-> NLRP8 | PPP2R1A | 5518 | protein-coding | PPP2R1A | protein phosphatase 2, regulatory subunit A, alpha | 126205 | protein-coding | NLRP8 | NLR family, pyrin domain containing 8 |
| Providence | +chr13:103249553->+chr13:32890559 | TPP2-> BRCA2 | TPP2 | 7174 | protein-coding | TPP2 | tripeptidyl peptidase II | 675 | protein-coding | BRCA2 | breast cancer 2, early onset |
| Providence | +chr1:32650217->-chr5:10433706 | TXLNA-> MARCH6 | TXLNA | 200081 | protein-coding | TXLNA | taxilin alpha | 10299 | protein-coding | MARCH6 | membrane-associated ring finger (C3HC4) 6, E3 ubiquitin protein ligase |
| Providence | +chr8:104709524->-chr8:105436617 | RIMS2-> DPYS | RIMS2 | 9699 | protein-coding | RIMS2 | regulating synaptic membrane exocytosis 2 | 1807 | protein-coding | DPYS | dihydropyrimidinase |
| Providence | -chr1:235628953->-chr1:235277225 | B3GALNT2-> TOMM20 | B3GALNT2 | 148789 | protein-coding | B3GALNT2 | beta-1,3-N-acetylgalactosaminyl-transferase 2 | 9804 | protein-coding | TOMM20 | translocase of outer mitochondrial membrane 20 homolog (yeast) |

TABLE A-continued

| Cohort | Fusion junction | Fusion genes | COSMIC gene | Donor Entrez gene ID | Donor gene type | Donor HUGO gene symbol | Donor gene description | Accept or Entrez gene ID | Accept or gene type | Accept or HUGO gene symbol | Accept or gene description |
|---|---|---|---|---|---|---|---|---|---|---|---|
| Providence | -chr1:38155278->+chr1:39792890 | C1orf109->MACF1 | | 54955 | protein-coding | C1orf109 | chromosome 1 open reading frame 109 | 23499 | protein-coding | MACF1 | microtubule-actin crosslinking factor 1 |
| Providence | -chr7:37840850->+chr17:37333788 | PGAP3->CACNB1 | PGAP3 | 93210 | protein-coding | PGAP3 | post-GPI attachment to proteins 3 | 782 | protein-coding | CACNB1 | calcium channel, voltage-dependent, beta 1 subunit |
| Providence | -chr4:153332455->+chr7:152055760 | FBXW7->MLL3 | FBXW7 | 55294 | protein-coding | FBXW7 | F-box and WD repeat domain containing 7, E3 ubiquitin protein ligase | 58508 | protein-coding | MLL3 | myeloid/lymphoid or mixed-lineage leukemia 3 |
| Providence | +chr6:41040823->+chr6:40347021 | NFYA->TDRG1 | | 4800 | protein-coding | NFYA | nuclear transcription factor Y, alpha | 732253 | miscRNA | TDRG1 | testis development related 1 (non-protein coding) |
| Providence | +chr18:39629569->-chr18:33613800 | PIK3C3->RPRD1A | | 5289 | protein-coding | PIK3C3 | phosphoinositide-3-kinase, class 3 | 55197 | protein-coding | RPRD1A | regulation of nuclear pre-mRNA domain containing 1A |
| Providence | +chr19:8386587->-chr16:52118478 | RPS28->LOC100505619 | | 6234 | protein-coding | RPS28 | ribosomal protein S28 | 100505619 | miscRNA | LOC100505619 | uncharacterized LOC100505619 |
| Providence | -chr5:175837258->+chr5:175995679 | CLTB->CDHR2 | | 1212 | protein-coding | CLTB | clathrin, light chain B | 54825 | protein-coding | CDHR2 | cadherin-related family member 2 |
| Providence | -chr5:58284320->+chr5:52218607 | PDE4D->ITGA1 | PDE4D | 5144 | protein-coding | PDE4D | phosphodiesterase 4D, cAMP-specific | 3672 | protein-coding | ITGA1 | integrin, alpha 1 |
| Providence | +chr17:5250220->+chr17:11532734 | RABEP1->DNAH9 | | 9135 | protein-coding | RABEP1 | rabaptin, RAB GTPase binding effector protein 1 | 1770 | protein-coding | DNAH9 | dynein, axonemal, heavy chain 9 |
| Providence | +chr17:5250220->+chr17:11532734 | RABEP1->DNAH9 | | 9135 | protein-coding | RABEP1 | rabaptin, RAB GTPase binding effector protein 1 | 1770 | protein-coding | DNAH9 | dynein, axonemal, heavy chain 9 |
| Providence | +chr11:36057799->-chr10:62039397 | LDLRAD3->ANK3 | LDLRAD3 | 143458 | protein-coding | LDLRAD3 | low density lipoprotein receptor class A domain containing 3 | 288 | protein-coding | ANK3 | ankyrin 3, node of Ranvier (ankyrin G) |
| Providence | +chr12:51034635->-chr13:45379166 | DIP2B->LINC00330 | DIP2B | 57609 | protein-coding | DIP2B | DIP2 disco-interacting protein 2 homolog B (Drosophila) | 144817 | miscRNA | LINC00330 | long intergenic non-protein coding RNA 330 |
| Providence | -chr18:77710724->+chr13:45379166 | PQLC1->LINC00330 | PQLC1 | 80148 | protein-coding | PQLC1 | PQ loop repeat containing 1 | 144817 | miscRNA | LINC00330 | long intergenic non-protein coding RNA 330 |
| Providence | -chr18:77710724->+chr13:45379166 | PQLC1->LINC00330 | PQLC1 | 80148 | protein-coding | PQLC1 | PQ loop repeat containing 1 | 144817 | miscRNA | LINC00330 | long intergenic non-protein coding RNA 330 |
| Providence | +chr3:100438902->+chr3:100348442 | TFG->GPR128 | TFG | 10342 | protein-coding | TFG | TRK-fused gene | 84873 | protein-coding | GPR128 | G protein-coupled receptor 128 |

TABLE A-continued

| Cohort | Fusion junction | Fusion genes | COSMIC gene | Donor Entrez gene ID | Donor gene type | Donor HUGO gene symbol | Donor gene description | Accept or Entrez gene ID | Accept or gene type | Accept or HUGO gene symbol | Accept or gene description |
|---|---|---|---|---|---|---|---|---|---|---|---|
| Providence | +chr3:100438902->+chr3:100348442 | TFG->GPR128 | TFG | 10342 | protein-coding | TFG | TRK-fused gene | 84873 | protein-coding | GPR128 | G protein-coupled receptor 128 |
| Providence | +chr11:68131170->-chr11:62863578 | LRP5->SLC22A24 | LRP5 | 4041 | protein-coding | LRP5 | low density lipoprotein receptor-related protein 5 | 283238 | protein-coding | SLC22A24 | solute carrier family 22, member 24 |
| Providence | +chr10:133761295->>-chr10:91344222 | PPP2R2D->PANK1 | PPP2R2D | 55844 | protein-coding | PPP2R2D | protein phosphatase 2, regulatory subunit B, delta | 53354 | protein-coding | PANK1 | pantothenate kinase 1 |
| Providence | +chr15:99442850->+chr18:50278424 | IGF1R->DCC | IGF1R | 3480 | protein-coding | IGF1R | insulin-like growth factor 1 receptor | 1630 | protein-coding | DCC | deleted in colorectal carcinoma |
| Providence | -chr20:16553874->+chr20:17240885 | KIF16B->PCSK2 | KIF16B | 55614 | protein-coding | KIF16B | kinesin family member 16B | 5126 | protein-coding | PCSK2 | proprotein convertase subtilisin/kexin type 2 |
| Providence | +chr2:223725976->+chr2:223553063 | ACSL3->MOGAT1 | ACSL3 | 2181 | protein-coding | ACSL3 | acyl-CoA synthetase long-chain family member 3 | 116255 | protein-coding | MOGAT1 | monoacylglycerol O-acyltransferase 1 |
| Providence | +chr17:37866134->-chr17:37949186 | ERBB2->IKZF3 | | 2064 | protein-coding | ERBB2 | v-erb-b2 erythroblastic leukemia viral oncogene homolog 2, neuro/glioblastoma derived oncogene homolog (avian) | 22806 | protein-coding | IKZF3 | IKAROS family zinc finger 3 (Aiolos) |
| Providence | +chr17:37868300->-chr17:37949186 | ERBB2->IKZF3 | | 2064 | protein-coding | ERBB2 | v-erb-b2 erythroblastic leukemia viral oncogene homolog 2, neuro/glioblastoma derived oncogene homolog (avian) | 22806 | protein-coding | IKZF3 | IKAROS family zinc finger 3 (Aiolos) |
| Providence | -chr17:78120592->-chr21:45953806 | EIF4A3->TSPEAR | EIF4A3 | 9775 | protein-coding | EIF4A3 | eukaryotic translation initiation factor 4A3 | 54084 | protein-coding | TSPEAR | thrombospondin-type laminin G domain and EAR repeats |
| Providence | +chr12:122473333->-chr12:103872225 | BCL7A->C12orf42 | BCL7A | 605 | protein-coding | BCL7A | B-cell CLL/lymphoma 7A | 374470 | protein-coding | C12orf42 | chromosome 12 open reading frame 42 |
| Providence | +chr6:71123405->-chr6:123038932 | FAM135A->PKIB | FAM135A | 57579 | protein-coding | FAM135A | family with sequence similarity 135, member A | 5570 | protein-coding | PKIB | protein kinase (cAMP-dependent, catalytic) inhibitor beta |

TABLE A-continued

| Cohort | Fusion junction | Fusion genes | COSMIC gene | Donor Entrez gene ID | Donor gene type | Donor HUGO gene symbol | Donor gene description | Accept or Entrez gene ID | Accept or gene type | Accept or HUGO gene symbol | Accept or gene description |
|---|---|---|---|---|---|---|---|---|---|---|---|
| Providence | −chr14:103523336−>−chr4:152594048 | CDC42BPB−>PET112 | CDC42BPB | 9578 | protein-coding | CDC42BPB | CDC42 binding protein kinase beta (DMPK-like) | 5188 | protein-coding | PET112 | PET112 homolog (yeast) |
| Providence | −chr14:51131897−>−chr14:51245522 | SAV1−>NIN | SAV1 | 60485 | protein-coding | SAV1 | salvador homolog 1 (Drosophila) | 51199 | protein-coding | NIN | ninein (GSK3B interacting protein) |
| Providence | −chr12:15370363−>+chr19:547280 | RERG−>GZMM | RERG | 85004 | protein-coding | RERG | RAS-like, estrogen-regulated, growth inhibitor | 3004 | protein-coding | GZMM | granzyme M (lymphocytemet-ase 1) |
| Providence | −chr19:35989618−>−chr19:35617921 | DMKN−>LGI4 | DMKN | 93099 | protein-coding | DMKN | dermokine | 163175 | protein-coding | LGI4 | leucine-rich repeat LGI family, member 4 |
| Providence | −chr21:27326904−>+chr21:30547033 | APP−>C21orf7 | APP | 351 | protein-coding | APP | amyloid beta (A4) precursor protein | 56911 | protein-coding | C21orf7 | chromosome 21 open reading frame 7 |
| Providence | +chr2:11680234−>−chr2:9098771 | GREB1−>MBOAT2 | GREB1 | 9687 | protein-coding | GREB1 | growth regulation by estrogen in breast cancer 1 | 129642 | protein-coding | MBOAT2 | membrane bound O-acyltransferase domain containing 2 |
| Providence | −chr12:116450602−>−chr12:39764063 | MED13L−>KIF21A | MED13L | 23389 | protein-coding | MED13L | mediator complex subunit 13-like | 55605 | protein-coding | KIF21A | kinesin family member 21A |
| Providence | −chr15:68695257−>+chr17:80417868 | ITGA11−>NARF | ITGA11 | 22801 | protein-coding | ITGA11 | integrin, alpha 11 | 26502 | protein-coding | NARF | nuclear prelamin A recognition factor |
| Providence | −chrX:122799493−>+chrX:117676688 | THOC2−>DOCK11 | THOC2 | 57187 | protein-coding | THOC2 | THO complex 2 | 139818 | protein-coding | DOCK11 | dedicator of cytokinesis 11 |
| Providence | −chr10:31608221−>+chr8:96166259 | ZEB1−>PLEKHF2 | ZEB1 | 6935 | protein-coding | ZEB1 | zinc finger E-box binding homeobox 1 | 79666 | protein-coding | PLEKHF2 | pleckstrin homology domain containing, family F (with FYVE domain) member 2 |
| Providence | −chr1:55610152−>−chr1:1769349 | PPP1R12C−>IFITM10 | PPP1R12C | 54776 | protein-coding | PPP1R12C | protein phosphatase 1, regulatory subunit 12C | 402778 | protein-coding | IFITM10 | interferon induced transmembrane protein 10 |
| Providence | −chr15:49059257−>+chr15:90976951 | CEP152−>IQGAP1 | CEP152 | 22995 | protein-coding | CEP152 | centrosomal protein 152 kDa | 8826 | protein-coding | IQGAP1 | IQ motif containing GTPase activating protein 1 |
| Providence | −chr1:169454801−>−chr3:113442942 | SLC19A2−>NAA50 | SLC19A2 | 10560 | protein-coding | SLC19A2 | solute carrier family 19 (thiamine transporter), member 2 | 80218 | protein-coding | NAA50 | N(alpha)-acetyl-transferase 50, NatE catalytic subunit |
| Providence | +chr5:174905642−>+chr5:110782384 | SFXN1−>CAMK4 | SFXN1 | 94081 | protein-coding | SFXN1 | sideroflexin 1 | 814 | protein-coding | CAMK4 | calcium/calmodulin-dependent protein kinase IV |
| Providence | +chr2:208435045−>−chr2:98543950 | CREB1−>TMEM131 | CREB | 1385 | protein-coding | CREB1 | cAMP responsive element binding protein 1 | 23505 | protein-coding | TMEM131 | transmembrane protein 131 |
| Providence | +chr6:152129499−>+chr6:151785588 | ESR1−>C6orf211 | | 2099 | protein-coding | ESR1 | estrogen receptor 1 | 79624 | protein-coding | C6orf211 | chromosome 6 open reading frame 211 |

TABLE A-continued

| Cohort | Fusion junction | Fusion genes | COSMIC gene | Donor Entrez gene ID | Donor gene type | Donor HUGO gene symbol | Donor gene description | Accept or Entrez gene ID | Accept or gene type | Accept or HUGO gene symbol | Accept or gene description |
|---|---|---|---|---|---|---|---|---|---|---|---|
| Providence | +chr8:117779030->-chr8:117879000 | UTP23-> RAD21 | | 84294 | protein-coding | UTP23 | UTP23, small subunit (SSU) processome component, homolog (yeast) | 5885 | protein-coding | RAD21 | RAD21 homolog (S. pombe) |
| Providence | -chr16:8776 0371->-chr4:3526778 | KLHDC4-> LRPAP1 | KLHDC4 | 54758 | protein-coding | KLHDC4 | kelch domain containing 4 | 4043 | protein-coding | LRPAP1 | low density lipoprotein receptor-related protein associated protein 1 |
| Providence | +chr7:7841374->+chr7:8043538 | LOC729852-> GLCCI1 | | 729852 | miscRNA | LOC729852 | uncharacterized LOC729852 | 113263 | protein-coding | GLCCI1 | glucocorticoid induced transcript 1 |
| Providence | +chr15:80750317->-chr15:81274523 | ARNT2-> MESDC2 | ARNT2 | 9915 | protein-coding | ARNT2 | aryl-hydrocarbon receptor nuclear translocator 2 | 23184 | protein-coding | MESDC2 | mesoderm development candidate 2 |
| Providence | +chr8:18067689->+chr8:38099768 | NAT1-> DDHD2 | | 9 | protein-coding | NAT1 | N-acetyltransferase 1 (arylamine N-acetyltransferase) | 23259 | protein-coding | DDHD2 | DDHD domain containing 2 |
| Providence | +chr9:129623018->-chr9:127818286 | ZBTB34-> SCAI | ZBTB34 | 403341 | protein-coding | ZBTB34 | zinc finger and BTB domain containing 34 | 286205 | protein-coding | SCAI | suppressor of cancer cell invasion |
| Providence | -chrX:76907604->-chrX:83419395 | ATRX-> RPS6KA6 | ATRX | 546 | protein-coding | ATRX | alphathalassemia/mental retardation syndrome X-linked | 27330 | protein-coding | RPS6KA6 | ribosomal protein S6 kinase, 90 kDa, polypeptide 6 |
| Providence | -chr9:103115054->-chr11:85742653 | TEX10-> PICALM | TEX10 | 54881 | protein-coding | TEX10 | testis expressed 10 | 8301 | protein-coding | PICALM | phosphatidylinositol binding clathrin assembly protein |
| Providence | +chr3:14960340->-chr4:75673359 | FGD5-> BTC | FGD5 | 152273 | protein-coding | FGD5 | FYVE, RhoGEF and PH domain containing 5 | 685 | protein-coding | BTC | betacellulin |
| Providence | -chr3:42744071->-chr11:73328878 | HHATL-> GRB2 | HHATL | 57467 | protein-coding | HHATL | hedgehog acyltransferase-like | 2885 | protein-coding | GRB2 | growth factor receptor-bound protein 2 |
| Providence | -chr6:117923167->+chr6:126359851 | GOPC-> TRMT11 | GOPC | 57120 | protein-coding | GOPC | golgi-associated PDZ and coiled-coil motif containing | 60487 | protein-coding | TRMT11 | tRNA methyltransferase 11 homolog (S. cerevisiae) |
| Providence | -chr9:14693227->-chr13:31037831 | ZDHHC21-> HMGB1 | | 340481 | protein-coding | ZDHHC21 | zinc finger, DHHC-type containing 21 | 3146 | protein-coding | HMGB1 | high mobility group box 1 |
| Providence | +chr9:95821112->-chr8:95511734 | SUSD3-> KIAA1429 | SUSD3 | 203328 | protein-coding | SUSD3 | sushi domain containing 3 | 25962 | protein-coding | KIAA1429 | KIAA1429 |
| Providence | +chr7:56032394->-chr7:82595803 | GBAS-> PCLO | GBAS | 2631 | protein-coding | GBAS | glioblastoma amplified sequence | 27445 | protein-coding | PCLO | piccolo (presynaptic cytomatrix protein) |
| Providence | +chr6:158244478->+chr8:61531139 | SNX9-> RAB2A | | 51429 | protein-coding | SNX9 | sorting nexin 9 | 5862 | protein-coding | RAB2A | RAB2A, member RAS oncogene family |
| Providence | -chr10:101769595->+chr10:123954555 | DNMBP-> TACC2 | DNMBP | 23268 | protein-coding | DNMBP | dynamin binding protein | 10579 | protein-coding | TACC2 | transforming, acidic coiled-coil containing protein 2 |

TABLE A-continued

| Cohort | Fusion junction | Fusion genes | COSMIC gene | Donor Entrez gene ID | Donor gene type | Donor HUGO gene symbol | Donor gene description | Accept or Entrez gene ID | Accept or gene type | Accept or HUGO gene symbol | Accept or gene description |
|---|---|---|---|---|---|---|---|---|---|---|---|
| Providence | +chr6:7108001->+chr6:7555951 | RREB1->DSP | RREB1 | 6239 | protein-coding | RREB1 | ras responsive element binding protein 1 | 1832 | protein-coding | DSP | desmoplakin |
| Providence | +chr1:111833572->+chr7:64291829 | CHIA->ZNF138 | | 27159 | protein-coding | CHIA | chitinase, acidic | 7697 | protein-coding | ZNF138 | zinc finger protein 138 |
| Providence | -chr19:37956215->-chr7:96324203 | ZNF569->SHFM1 | ZNF569 | 148266 | protein-coding | ZNF569 | zinc finger protein 569 | 7979 | protein-coding | SHFM1 | split hand/foot malformation (ectrodactyly) type 1 |
| Rush | -chr17:57092971->+chr17:58786580 | TRIM37->BCAS3 | | 4591 | protein-coding | TRIM37 | tripartite motif containing 37 | 54828 | protein-coding | BCAS3 | breast carcinoma amplified sequence 3 |
| Rush | +chr22:22020420->+chr22:30064322 | PPIL2->NF2 | | 23759 | protein-coding | PPIL2 | peptidyl prolylisomerase (cyclophilin)-like 2 | 4771 | protein-coding | NF2 | neurofibromin 2 (merlin) |
| Rush | -chr1:53746259->-chr1:54275419 | LRP8->TMEM48 | | 7804 | protein-coding | LRP8 | low density lipoprotein receptor-related protein 8, apolipoprotein receptor | 55706 | protein-coding | TMEM48 | transmembrane protein 48 |
| Rush | +chr17:48797192->-chr17:36047395 | LUC7L3->HNF1B | | 51747 | protein-coding | LUC7L3 | LUC7-like 3 (S. cerevisiae) | 6928 | protein-coding | HNF1B | HNF1 homeobox B |
| Rush | -chr8:117878825->+chr8:124968232 | RAD21->FER1L6 | | 5885 | protein-coding | RAD21 | RAD21 homolog (S. pombe) | 654463 | protein-coding | FER1L6 | fer-1-like 6 (C. elegans) |
| Rush | +chr3:100438902->+chr3:100348442 | TFG->GPR128 | TFG | 10342 | protein-coding | TFG | TRK-fused gene | 84873 | protein-coding | GPR128 | G protein-coupled receptor 128 |
| Rush | +chr7:33968994->-chr7:96115729 | AP2B1->FLJ42280 | | 163 | protein-coding | AP2B1 | adaptor-related protein complex 2, beta 1 subunit | 401388 | protein-coding | FLJ42280 | putative uncharacterized protein FLJ42280 |
| Rush | +chr3:100438902->+chr3:100348442 | TFG->GPR128 | TFG | 10342 | protein-coding | TFG | TRK-fused gene | 84873 | protein-coding | GPR128 | G protein-coupled receptor 128 |
| Rush | +chr4:71670133->-chr4:71337932 | RUFY3->MUC7 | | 22902 | protein-coding | RUFY3 | RUN and FYVE domain containing 3 | 4589 | protein-coding | MUC7 | mucin 7, secreted |
| Rush | +chr3:100438902->+chr3:100348442 | TFG->GPR128 | TFG | 10342 | protein-coding | TFG | TRK-fused gene | 84873 | protein-coding | GPR128 | G protein-coupled receptor 128 |
| Rush | +chr3:100438902->+chr3:100348442 | TFG->GPR128 | TFG | 10342 | protein-coding | TFG | TRK-fused gene | 84873 | protein-coding | GPR128 | G protein-coupled receptor 128 |
| Rush | +chr7:73521906->-chr3:131442469 | LLGL2->CPNE4 | | 3993 | protein-coding | LLGL2 | lethal giant larvae homolog 2 (Drosophila) | 131034 | protein-coding | CPNE4 | copine IV |
| Rush | -chr2:97527316->-chr2:28561317 | SEMA4C->BRE | SEMA4C | 54910 | protein-coding | SEMA4C | sema domain, immunoglobulin domain (Ig), transmembrane domain (TM) and short cytoplasmic domain, (semaphorin) 4C | 9577 | protein-coding | BRE | brain and reproductive organ-expressed (TNFRSF1A modulator) |
| Rush | +chr6:152201906->+chr6:151669846 | ESR1->AKAP12 | | 2099 | protein-coding | ESR1 | estrogen receptor 1 | 9590 | protein-coding | AKAP12 | A kinase (PRKA) anchor protein 12 |

TABLE A-continued

| Cohort | Fusion junction | Fusion genes | COSMIC gene | Donor Entrez gene ID | Donor gene type | Donor HUGO gene symbol | Donor gene description | Accept or Entrez gene ID | Accept or gene type | Accept or HUGO gene symbol | Accept or gene description |
|---|---|---|---|---|---|---|---|---|---|---|---|
| Rush | −chr17:58577760−>+chr17:72345323 | APPBP2−>KIF19 | | 10513 | protein-coding | APPBP2 | amyloid beta precursor protein (cytoplasmic tail) binding protein 2 | 124602 | protein-coding | KIF19 | kinesin family member 19 |
| Rush | +chr8:38883403−>−chr8:41585524 | ADAM9−>ANK1 | | 8754 | protein-coding | ADAM9 | ADAM metallopeptidase domain 9 | 286 | protein-coding | ANK1 | ankyrin 1, erythrocytic |
| Rush | −chr17:27492960−>chr17:28120955 | MYO18A−>SSH2 | | 399687 | protein-coding | MYO18A | myosin XVIIIA | 85464 | protein-coding | SSH2 | slingshot homolog 2 (Drosophila) |
| Rush | +chr7:30113748−>−chr9:80537261 | PLEKHA8−>GNAQ | | 84725 | protein-coding | PLEKHA8 | pleckstrin homology domain containing, family A (phosphoinositide binding specific) member 8 | 2776 | protein-coding | GNAQ | guanine nucleotide binding protein (G protein), q polypeptide |
| Rush | −chr17:37453380−>+chr17:44751780 | FBXL20−>NSF | | 84961 | protein-coding | FBXL20 | F-box and leucine-rich repeat protein 20 | 4905 | protein-coding | NSF | N-ethylmaleimide-sensitive factor |
| Rush | −chr17:57094657−>+chr17:58786580 | TRIM37−>BCAS3 | | 4591 | protein-coding | TRIM37 | tripartite motif containing 37 | 54828 | protein-coding | BCAS3 | breast carcinoma amplified sequence 3 |
| Rush | −chr20:62421174−>+chr20:62559688 | ZBTB46−>DNAJC5 | | 140685 | protein-coding | ZBTB46 | zinc finger and BTB domain containing 46 | 80331 | protein-coding | DNAJC5 | DnaJ (Hsp40) homolog, subfamily C, member 5 |
| Rush | +chr6:152201906−>+chr6:151669846 | ESR1−>AKAP12 | ESR1 | 2099 | protein-coding | ESR1 | estrogen receptor 1 | 9590 | protein-coding | AKAP12 | A kinase (PRKA) anchor protein 12 |

TABLE B

| Gene Fusion | Chimera Sequence | SEQ ID NO. |
|---|---|---|
| LRP5-> KAT6A | ATGGAGGCAGCGCCGCCCGGGCCGCCGTGGCCGCTGCTGCTGCTGCTGCT GCTGCTGCTGGCGCTGTGCGGCTGCCCGGCCCCCGCCGCGGATGGTAAAA CTCGCAAACCCGCTTTATACTGAGTGGATTTTGGAGGCCATCAAAAAAGT GAAAAAGCAGAAACAGCGTCCTTCAGAAGAAAGGATATGCAATGCTGTG TCTTCATCCCATGGCTTGGATCGTAAAACTGTTTTAGAACAATTGGAGTTG AGTGTTAAAGATGGAACAATTTTAAAAGTCTCAAATAAAGGACTCAATTC CTATAAAGATCCTGATAATCCTGGGCGAATAGCACTTCCTAAGCCTCGGA ACCATGGAAAATTGGATAATAAACAAATGTGGATTGGAATAAACTGAT AAAGCGGGCAGTTGAGGGCTTGGCAGAGTCTGGTGGCTCAACTTTGAAA AGCATTGAACGTTTTTTGAAAGGTCAGAAGGATGTGTCTGCATTATTCGG AGGCAGTGCTGCCTCTGGCTTTCACCAGCAGTTACGATTGGCTATCAAAC GTGCCATTGGCCACGGCAGACTCCTTAAAGATGGACCTCTTTATCGGCTC AACACTAAAGCAACCAACGTGGATGGGAAAGAGAGTTGTGAGTCTCTTT CCTGTTTACCTCCAGTGTCCCTTCTTCCACATGAAAAGGATAAGCCGGTTG CTGAACCAATCCCCATCTGTAGTTTCTGTCTTGGTACAAAAGAACAAAAC CGAGAAAAGAAGCCAGAGGAACTCATCTCCTGTGCCGACTGTGGCAACA GTGGCCATCCATCCTGTTTAAAGTTTTCCCCTGAACTAACGGTTCGAGTGA AGGCCTTACGGTGGCAGTGCATCGAGTGTAAAACATGCAGCTCCTGTCGA GATCAAGGCAAAAATGCGGATAACATGCTCTTTTGTGATTCATGTGACCG AGGTTTTCACATGGAGTGTTGTGATCCGCCACTCACCCGTATGCCAAAAG GCATGTGGATATGTCAAATATGTCGACCTAGGAAAAAAGGACGAAAACT TCTACAAAAGAAGGCAGCACAGATAAAACGGCGCTATACTAATCCAATA GGACGTCCAAAAAACAGGTTAAAGAAACAAAACACGGTATCAAAAGGTC CCTTCAGCAAAGTTCGAACTGGCCCTGGAAGGGGTAGGAAACGAAAAAT CACTCTTTCCAGCCAATCAGCATCATCATCATCAGAAGAAGGATATTTAG AGCGGATAGATGGCTTGGACTTCTGCAGAGATAGCAATGTCTCCTTGAAG TTCAACAAGAAAACCAAAGGGCTCATTGATGGCCTTACCAAATTTTTTAC CCCTTCCCCTGATGGGCGGAAAGCTCGGGGGGAAGTGGTGGACTACTCTG AGCAATATCGAATCAGAAAGAGGGGCAACAGGAAATCAAGCACTTCAGA TTGGCCCACAGACAATCAGGATGGCTGGGATGGCAAACAAGAAATGAG GAGCGACTTTTTGGGAGCCAGGAAATCATGACTGAGAAAGATATGGAAT TATTTCGTGATATCCAAGAACAAGCACTGCAGAAAGTTGGAGTGACTGGT CCCCCTGATCCACAAGTCCGCTGTCCCTCTGTCATTGAGTTTGGGAAGTAT GAAATTCACACCTGGTACTCCTCCCCATATCCTCAAGAATACTCAAGGCT GCCCAAATTGTATCTTTGTGAATTTTGTCTAAAATATATGAAAAGTAGAA CTATTCTGCAGCAGCACATGAAGAAATGTGGTTGGTTCCATCCTCCTGCC AATGAGATTTACAGAAAGAATAATATTTCTGTCTTTGAGGTTGATGGGAA TGTGAGTACCATTTATTGTCAAAAACCTGTGTCTTTTGGCAAAGTTGTTCT TGACCACAAAAACCCTCTATTACGATGTGGAGCCATTTCTTTTTTATGTACT AACACAGAATGATGTCAAGGGCTGCCACCTTGTTGGCTACTTTTCTAAGG AAAAGCACTGCCAACAGAAGTACAATGTTTCCTGTATAATGATTCTTCCT CAATACCAGCGTAAGGGCTATGGCAGGTTTCTCATCGATTTCAGTTATTT GTTATCAAAGCGTGAAGGCCAAGCAGGGTCTCCAGAGAAACCGTTATCT GATCTGGGTCGTCTTTCCTACATGGCATATTGGAAAAGTGTAATATTGGA GTGCCTTTATCACCAAAATGACAAGCAGATCAGCATTAAGAAGTTAAGCA AGTTGACTGGAATCTGCCCTCAAGACATCACTTCCACACTCCACCACCTA CGAATGCTGGACTTCCGTAGTGACCAATTTGTGATTATCCGCCGGGAAAA ACTTATCCAGGATCACATGGCAAAGCTTCAGCTGAATTTGCGACCTGTAG ATGTAGATCCAGAATGTTTGCGCTGGACTCCAGTCATAGTGTCCAACTCT GTGGTCTCAGAGGAGGAAGAAGAGGAGGCTGAGGAAGGAGAAAACGAA GAGCCACAGTGCCAGGAAAGAGAATTAGAGATCAGTGTGGGAAAGTCTG TGTCTCATGAGAACAAAGAACAAGATTCTTATTCAGTAGAAAGTGAAAA GAAACCAGAAGTTATGGCTCCAGTCAGTTCTACACGTTTGAGCAAACAAG TCCTTCCTCATGATAGTCTTCCTGCAAATAGCCAGCCATCTCGGAGGGGC CGCTGGGGAGGAAGAACAGAAAAACCCAGGAACGTTTTGGTGATAAAG ATTCTAAACTGCTCTTGGAAGAGACGTCTTCAGCTCCTCAGGAACAATAT GGAGAATGTGGGGAGAAATCAGAAGCCACCCAGGAACAATACACTGAAA GTGAAGAACAGCTGGTGGCTTCTGAGGAGCAGCCAAGCCAGGACGGGAA ACCTGACCTTCCCAAGAGAAGACTCAGTGAGGGGGTTGAGCCCTGGCGA GGACAGCTCAAGAAAAAGCCCTGAGGCTCTGAAGTGCAGATTAACAGAAG GAAGTGAGAGGCTGCCCCGTCGCTACAGTGAGGGTGACAGGGCTGTCCT CAGGGGCTTCAGTGAGAGCAGCGAGGAGGAGGAGCCGGAAAGCCC TCGGTCAAGCTCGCCACCAATTCTCACAAAGCCCACGCTGAAGCGAAAG AAACCATTTCTCCACCGAAGGAGGAGAGTCCGAAAGCGCAAACACCACA ATAGCAGTGTAGTCACAGAAACTATTTCTGAGACCACTGAAGTGTTAGAT GAACCTTTTGAAGATTCTGACTCCGAGAGGCCAATGCCAAGATTAGAACC CACGTTTGAGATCGATGAAGAAGAGGAGGAAGAGGATGAAAATGAACTT TTCCCTAGAGAATACTTCCGTCGTTTGTCTTCGCAGGATGTACTCAGGTGT CAGTCCTCTTCTAAGAGGAAGTCTAAAGATGAAGAAGAAGATGAAGAGT CAGATCTGATGCTGATGCACACTCCTATCTTAAAGCCAGTATCTCTTTTGCGA AAACGTGATGTGAAGAATTCTCCTCTTGAGCCAGATACATCCACACCTTT GAAAAAGAAAAGGGATGGCCAAAGGCAAGAGCCGCAAACCAATCCA CTGGAAGAAAAGACCTGGTCGAAAACCAGGATTTAAGTTGAGTCGGGAA ATCATGCCAGTTTCTACTCAAGCATGCGTCATTGAGCCCATCGTTTCCATT CCTAAAGCTGGACGTAAACCCAAGATCCAGGAGAGTGAAGAAACTGTTG AGCCAAAAGAAGACATGCCCCTACCCGAGGAGAGGAAGGAGGAGGAGG AGATGCAAGCAGAGGCAGAAGAGGCTGAAGAGGGTGAGGAAGAGGATG | SEQ ID NO: 1 |

TABLE B-continued

| Gene Fusion | Chimera Sequence | SEQ ID NO. |
|---|---|---|
| | CAGCCAGCAGTGAAGTCCCAGCAGCCTCTCCAGCAGACAGCAGCAATAG
TCCTGAGACCGAAACCAAGGAGCCTGAGGTGGAGGAGGAAGAAGAGAA
GCCCCGTGTCTCAGAGGAGCAGAGGCAGTCAGAGGAGGAGCAGCAGGAA
TTAGAGGAGCCAGAGCCAGAGGAGGAGGAAGATGCAGCTGCAGAGACT
GCCCAGAATGACGACCACGACGCTGATGATGAGGATGATGCCACCTGG
AGTCCACAAAGAAAAAGGAGCTAGAGGAACAGCCCACGAGGGAAGATG
TCAAGGAGGAGCCTGGTGTTCAAGAGTCTTTTTTAGATGCTAATATGCAG
AAGAGTAGGGAAAAGATAAAGGATAAAGAGGAAACCGAGCTGGATTCC
GAAGAGGAGCAGCCTTCCCATGACACGTCCGTGGTGTCAGAGCAGATGG
CTGGGTCTGAGGACGACCACGAAGAAGACTCCCACACTAAGGAAGAGTT
AATCGAATTAAAAGAGGAGGAAGAGATTCCTCATAGTGAGCTGGATCTG
GAAACTGTACAGGCAGTGCAGTCTTTGACTCAAGAAGAAAGCAGTGAGC
ATGAGGGCGCCTACCAGGACTGTGAGGAAACTCTTGCGGCGTGTCAGAC
CCTGCAGAGTTACACCCAGGCTGACGAGGACCCTCAGATGTCCATGGTTG
AAGACTGTCATGCGTCAGAACATAATAGCCCTATCTCCTCCGTTCAGTCT
CACCCCAGCCAGTCAGTCCGTTCGGTCAGCAGTCCCAACGTGCCTGCCCT
TGAGAGTGGCTACACCCAGATCAGCCCAGAACAAGGATCCCTGTCCGCA
CCCTCTATGCAGAACATGGAGACCAGCCCCATGATGGATGTGCCTTCCGT
ATCAGACCACTCTCAGCAGGTGGTGGACAGCGGCTTCAGTGACCTGGGCA
GCATTGAGAGCACCACTGAAAACTATGAGAACCCAAGCAGTTACGACTC
CACGATGGGCGGCAGCATCTGTGGGAACAGCTCTTCCCAGAGCAGCTGCT
CCTACGGTGGGCTGTCGTCCTCCAGCAGCCTCACCCAGAGCAGCTGTGTG
GTCACTCAGCAGATGGCCAGCATGGGCAGCAGCTGCAGCATGATGCAGC
AGAGCAGCGTCCAGCCTGCTGCCAACTGCAGCATCAAGTCACCTCAGAGC
TGCGTGGTGGAGAGGCCTCCCAGTAACCAGCAGCAGCAGCCGCCACCAC
CGCCTCCACAGCAGCCACAGCCGCCGCCGCCACAACCACAACCAGCACC
ACAGCCTCCACCACCCCAGCAGCAGCCGCAACAGCAGCCGCAGCCTCAG
CCCCAGCAGCCTCCACCCCCACCCCCTCCCCAGCAGCAGCCCCGCTGTC
ACAGTGTAGTATGAATAACAGTTTCACCCCAGCTCCTATGATCATGGAGA
TACCAGAATCTGGAAGCACTGGGAACATAAGTATCATGAGAGGATTCC
AGGGGATTTTGGTGCCGGCAGCTACTCTCAACCATCAGCCACCTTCAGCC
TAGCCAAGCTGCAGCAGCTGACCAACACCATTATGGACCCTCATGCCATG
CCTTATAGCCATTCTCCTGCTGTGACTTCCTATGCAACCAGTGTTTCTCTG
TCCAATACAGGACTGGCTCAGCTGGCTCCATCTCATCCCTTAGCTGGGAC
TCCTCAAGCACAAGCCACCATGACGACCACCCCCAAACTTGGCATCCACTA
CCATGAACCTCACATCTCCTCTGCTTCAGTGCAACATGTCTGCCACCAAC
ATTGGCATTCCTCACACGCAGAGATTGCAAGGGCAAATGCCAGTGAAGG
GGCACATTTCCATCCGCTCCAAGTCTGCGCCACTGCCCTCTGCGGCTGCTC
ACCAGCAGCAGCTGTATGCCGTAGCCCATCGGCAGTTGCCATGCAGGCT
GGCCCTCGCGCACTGGCTGTTCAGCGTGGCATGAACATGGGGGTTAATCT
GATGCCTACTCCCGCCTATAATGTCAATTCCATGAATATGAACACCTTGA
ATGCCATGAACAGCTATCGAATGACACAGCCCATGATGAACAGCAGTTA
CCATAGTAACCCTGCCTACATGAACCAGACAGCACAGTATCCTATGCAGA
TGCAGATGGGAATGATGGGGAGCCAGGCCTATACCCAGCAGCCTATGCA
GCCTAACCCTCATGGGAACATGATGTACACAGGCCCCTCCCATCACAGCT
ACATGAACGCTGCTGGCGTGCCCAAGCAGTCACTCAACGGACCTTACATG
AGAAGATGA | |
| ESR1-><br>AKAP12 | ATGACCATGACCCTCCACACCAAAGCATCTGGGATGGCCCTACTGCATCA
GATCCAAGGGAACGAGCTGGAGCCCCTGAACCGTCCGCAGCTCAAGATC
CCCCTGGAGCGGCCCCTGGGCGAGGTGTACCTGGACAGCAGCAAGCCCG
CCGTGTACAACTACCCCGAGGGCGCCGCCTACGAGTTCAACGCCGCGGCC
GCCGCCAACGCGCAGGTCTACGGTCAGACCGGCCTCCCCTACGGCCCCGG
GTCTGAGGCTGCGGCGTTCGGCTCCAACGGCCTGGGGGGTTTCCCCCCAC
TCAACAGCGTGTCTCCGAGCCCGCTGATGCTACTGCACCCGCCGCCGCAG
CTGTCGCCTTTCCTGCAGCCCCACGGCCAGCAGGTGCCCTACTACCTGGA
GAACGAGCCCAGCGGCTACACGGTGCGCGAGGCCGGCCCGCCGGCATTC
TACAGGCCAAATTCAGATAATCGACGCCAGGGTGGCAGAGAAAGATTGG
CCAGTACCAATGACAAGGGAAGTATGGCTATGGAATCTGCCAAGGAGAC
TCGCTACTGTGCAGTGTGCAATGACTATGCTTCAGGCTACCATTATGGAG
TCTGGTCCTGTGAGGGCTGCAAGGCCTTCTTCAAGAGAAGTATTCAAGGA
CATAACGACTATATGTGTCCAGCCACCAACCAGTGCACCATTGATAAAAA
CAGGAGGAAGAGCTGCCAGGCCTGCCGGCTCCGTAAATGCTACGAAGTG
GGAATGATGAAAGGTGGGATACGAAAAGACCGAAGAGGAGGGAGAATG
TTGAAACACAAGCGCCAGAGAGATGATGGGGAGGGCAGGGGTGAAGTG
GGGTCTGCTGGAGACATGAGAGCTGCCAACCTTTGGCCAAGCCCGCTCAT
GATCAAACGCTCTAAGAAGAACAGCCTGGCCTTGTCCCTGACGGCCGACC
AGATGGTCAGTGCCTTGTTGGATGCTGAGCCCCGATACTCTATTCCGAG
TATGATCCTACCAGACCCTTCAGTGAAGCTTCGATGATGGGCTTACTGAC
CAACCTGGCAGACAGGGAGCTGGTTCACATGATCAACTGGGCGAAGAGG
GTGCCAGTTGGACAGAGAGACTCTGAAGATGTGAGCAAAAGAGACTCCG
ATAAAGAGATGGCTACTAAGTCAGCGGTTGTTCACGACATCACAGATGAT
GGGCAGGAGGAGACACCCGAAATAATCGAACAGATTCCTTCTTCAGAAA
GCAATTTAGAAGAGCTAACACAACCCACTGAGTCCCAGGCTAATGATATT
GGATTTAAGAAGGTGTTTAAGTTTGTTGGCTTTAAATTCACTGTGAAAAA
GGATAAGACAGAGAAGCCTGACACTGTCCAGCTACTCACTGTGAAGAAA
GATGAAGGGGAGGGAGCAGCAGGGGCTGGCGACCACAAGGACCCCCAGC | SEQ ID NO: 2 |

TABLE B-continued

| Gene Fusion | Chimera Sequence | SEQ ID NO. |
|---|---|---|
| | CTTGGGGCTGGAGAAGCAGCATCCAAAGAAAGCGAACCCAAACAATCTA<br>CAGAGAAACCCGAAGAGACCCTGAAGCGTGAGCAAAGCCACGCAGAAAT<br>TTCTCCCCCAGCCGAATCTGGCCAAGCAGTGGAGGAATGCAAAGAGGAA<br>GGAGAAGAGAAACAAGAAAAAGAACCTAGCAAGTCTGCAGAATCTCCGA<br>CTAGTCCCGTGACCAGTGAAACAGGATCAACCTTCAAAAAATTCTTCACT<br>CAAGGTTGGGCCGGCTGGCGCAAAAAGACCAGTTTCAGGAAGCCGAAGG<br>AGGATGAAGTGGAAGCTTCAGAGAAGAAAAAGGAACAAGAGCCAGAAA<br>AAGTAGACACAGAAGAAGACGGAAAGGCAGAGGTTGCCTCCGAGAAACT<br>GACCGCCTCCGAGCAAGCCCACCCACAGGAGCCGGCAGAAAGTGCCCAC<br>GAGCCCCGGTTATCAGCTGAATATGAGAAAGTTGAGCTGCCCTCAGAGG<br>AGCAAGTCAGTGGCTCGCAGGGACCTTCTGAAGAGAAACCTGCTCCGTTG<br>GCGACAGAAGTGTTTGATGAGAAATAGAAGTCCACCAAGAAGAGGTTG<br>TGGCCGAAGTCCACGTCAGCACCGTGGAGGAGAGAACCGAAGAGCAGAA<br>AACGGAGGTGGAAGAAACAGCAGGGTCTGTGCCAGCTGAAGAATTGGTT<br>GAAATGGATGCAGAACCTCAGGAAGCTGAACCTGCCAAGGAGCTGGTGA<br>AGCTCAAAGAAACGTGTGTTTCCGGAGAGGACCCTACACAGGGAGCTGA<br>CCTCAGTCCTGATGAGAAGGTGCTGTCCAAACCCCCGAAGGCGTTGTGA<br>GTGAGGTGGAAATGCTGTCATCACAGGAGAATGAAGGTGCAGGGAAG<br>TCCACTAAAGAAGCTTTTTACCAGCACTGGCTTAAAAAAGCTTTCTGGAA<br>AGAAACAGAAAGGGAAAGAGGAGGAGGAGACGAGGAATCAGGGGAGC<br>ACACTCAGGTTCCAGCCGATTCTCCGGACAGCCAGGAGGAGCAAAAGGG<br>CGAGAGCTCTGCCTCATCCCTGAGGAGCCCGAGGAGATCACGTGTCTGG<br>AAAAGGGCTTAGCCGAGGTGCAGCAGGATGGGGAAGCTGAAGAAGGAG<br>CTACTTCCGATGGAGAGAAAAAAGAGAAGGTGTCACTCCCTGGGCATC<br>ATTCAAAAAGATGGTGACGCCCAAGAAGCGTGTTAGACGGCCTTCGGAA<br>AGTGATAAAGAAGATGAGCTGGACAAGGTCAAGAGCGCTACCTTGTCTT<br>CCACCGAGAGCACAGCCTCTGAAATGCAAGAAGAAATGAAAGGGAGCGT<br>GGAAGAGCCAAAGCCGGAAGAACCAAAGCGCAAGGTGGATACCTCAGTA<br>TCTTGGGAAGCTTTAATTTGTGTGGGATCATCCAAGAAAAGAGCAAGGAG<br>AGGGTCCTCTTCTGATGAGGAAGGGGGACCAAAAGCAATGGGAGGAGAC<br>CACCAGAAAGCTGATGAGGCCGAAAAGACAAAGAGACGGGGACAGAC<br>GGGATCCTTGCTGGTTCCCAAGAACATGATCCAGGGCAGGGAAGTTCCTC<br>CCCGGAGCAAGCTGGAAGCCCTACCGAAGGGGAGGGCGTTTCCACCTGG<br>GAGTCATTTAAAAGGTTAGTCACGCCAAGAAAAAAATCAAAGTCCAAGC<br>TGGAAGAGAAAAGCGAAGACTCCATAGCTGGGTCTGGTGTAGAACATTC<br>CACTCCAGACACTGAACCCGGTAAAGAAGAATCCTGGGTCTCAATCAAG<br>AAGTTTATTCCTGGACGAAGGAAGAAAAGGCCAGATGGGAAACAAGAAC<br>AAGCCCCTGTTGAAGACGCAGGGCCAACAGGGGCAACGAAGATGACTC<br>TGATGTCCCGGCCGTGGTCCCTCTGTCTGAGTATGATGCTGTAGAAAGGG<br>AGAAAATGGAGGCACAGCAAGCCCAAAAAAGCGCAGAGCAGCCCGAGC<br>AGAAGGCAGCCACTGAGGTGTCCAAGGAGCTCAGCGAGAGTCAGGTTCA<br>TATGATGGCAGCAGCTGTCGCTGACGGGACGAGGGCAGCTACCATTATTG<br>AAGAAAGGTCTCCTTCTTGGATATCTGCTTCAGTGACAGAACCTCTTGAA<br>CAAGTAGAAGCTGAAGCCGCACTGTTAACTGAGGAGGTATTGGAAAGAG<br>AAGTAATTGCAGAAGAAGAACCCCCCACGGTTACTGAACCTCTGCCAGA<br>GAACAGAGAGGCCCGGGGCGACACGGTCGTTAGTGAGGCGGAATTGACC<br>CCCGAAGCTGTGACAGCTGCAGAAACTGCAGGGCCATTGGGTGCCGAAG<br>AAGGAACCGAAGCATCTGCTGCTGAAGAGACCACAGAAATGGTGTCAGC<br>AGTCTCCCAGTTAACCGACTCCCCAGACACCACAGAGGAGGCCACTCCGG<br>TGCAGGAGGTGGAAGGTGGCGTACCTGACATAGAAGAGCAAGAGAGGCG<br>GACTCAAGAGGTCCTCCAGGCAGTGGCAGAAAAAGTGAAAGAGGAATCC<br>CAGCTGCCTGGCACCGGTGGGCCAGAAGATGTGCTTCAGCCTGTGCAGAG<br>AGCAGAGGCAGAAAGACCAGAAGAGCAGGCTGAAGCGTCGGGTCTGAA<br>GAAAGAGACGGATGTAGTGTTGAAAGTAGATGCTCAGGAGGCAAAAACT<br>GAGCCTTTTACACAAGGGAAGGTGGTGGGGCAGACCACCCCAGAAAGCT<br>TTGAAAAAGCTCCTCAAGTCACAGAGAGCATAGAGTCCAGTGAGCTTGTA<br>ACCACTTGTCAAGCCGAAACCTTAGCTGGGGTAAAATCACAGGAGATGG<br>TGATGGAACAGGCTATCCCCCTGACTCGGTGGAAACCCCTACAGACAGT<br>GAGACTGATGGAAGCACCCCCGTAGCCGACTTTGACGCACCAGGCACAA<br>CCCAGAAAGACGAGATTGTGGAAATCCATGAGGAGAATGAGGTCGCATC<br>TGGTACCCAGTCAGGGGGCACAGAAGCAGAGGCAGTTCCTGCACAGAAA<br>GAGAGGCCTCCAGCACCTTCCAGTTTTGTGTTCCAGGAAGAAACTAAAGA<br>ACAATCAAAGATGGAAGACACTCTAGAGCATACAGATAAAGAGGTGTCA<br>GTGGAAACTGTATCCATTCTGTCAAAGACTGAGGGGACTCAAGAGGCTG<br>ACCAGTATGCTGATGAGAAAACCAAAGACGTACCATTTTTCGAAGGACTT<br>GAGGGGTCTATAGACACAGGCATAACAGTCAGTCGGGAAAAGGTCACTG<br>AAGTTGCCCTTAAAGGTGAAGGGACAGAAGAAGCTGAATGTAAAAAGGA<br>TGATGCTCTTGAACTGCAGAGTCACGCTAAGTCTCCTCCATCCCCCGTGG<br>AGAGAGAGATGGTAGTTCAAGTCGAAAGGGAGAAAACAGAAGCAGAGC<br>CAACCCATGTGAATGAAGAGAAGCTTGAGCACGAAACAGCTGTTACCGT<br>ATCTGAAGAGGTCAGTAAGCAGCTCCTCCAGACAGTGAATGTGCCCATCA<br>TAGATGGGGCAAAGGAAGTCAGCAGTTTGGAAGGAAGCCCTCCTCCCTG<br>CCTAGGTCAAGAGGAGGCAGTATGCACCAAAATTCAAGTTCAGAGCTCT<br>GAGGCATCATTCACTCTAACAGCGGCTGCAGAGGAGGAAAAGGTCTTAG<br>GAGAAACTGCCAACATTTTAGAAACAGGTGAAACGTTGGAGCCTGCAGG<br>TGCACATTTAGTTCTGGAAGAGAAATCCTCTGAAAAAAATGAAGACTTTG<br>CCGCTCATCCAGGGGAAGATGCTGTGCCCACAGGGCCCGACTGTCAGGC | |

TABLE B-continued

| Gene Fusion | Chimera Sequence | SEQ ID NO. |
|---|---|---|
| | AAAATCGACACCAGTGATAGTATCTGCTACTACCAAGAAAGGCTTAAGTT CCGACCTGGAAGGAGAGAAAACCACATCACTGAAGTGGAAGTCAGATGA AGTCGATGAGCAGGTTGCTTGCCAGGAGGTCAAAGTGAGTGTAGCAATT GAGGATTTAGAGCCTGAAAATGGGATTTTGGAACTTGAGACCAAAAGCA GTAAACTTGTCCAAAACATCATCCAGACAGCCGTTGACCAGTTTGTACGT ACAGAAGAAACAGCCACCGAAATGTTGACGTCTGAGTTACAGACACAAG CTCACGTGATAAAAGCTGACAGCCAGGACGCTGGACAGGAAACGGAGAA AGAAGGAGAGGAACCTCAGGCCTCTGCACAGGATGAAACACCAATTACT TCAGCCAAAGAGGAGTCAGAGTCAACCGCAGTGGGACAAGCACATTCTG ATATTTCCAAAGACATGAGTGAAGCCTCAGAAAAGACCATGACTGTTGA GGTAGAAGGTTCCACTGTAAATGATCAGCAGCTGGAAGAGGTCGTCCTCC CATCTGAGGAAGAGGGAGGTGGAGCTGGAACAAAGTCTGTGCCAGAAGA TGATGGTCATGCCTTGTTAGCAGAAAGAATAGAGAAGTCACTAGTTGAAC CGAAAGAAGATGAAAAAGGTGATGATGTTGATGACCCTGAAAACCAGAA CTCAGCCCTGGCTGATACTGATGCCTCAGGAGGCTTAACCAAAGAGTCCC CAGATACAAATGGACCAAAACAAAAGAGAAGGAGGATGCCCAGGAAG TAGAATTGCAGGAAGGAAAAGTGCACAGTGAATCAGATAAAGCGATCAC ACCCCAAGCACAGGAGGAGTTACAGAAACAAGAGAGAGAATCTGCAAA GTCAGAACTTACAGAATCTTAA | |
| SEMA4C -> RBMS1 | ATGGCCCCACACTGGGCTGTCTGGCTGCTGGCAGCAAGGCTGTGGGGCCT GGGCATTGGGGCTGAGGTGTGGTGGAACCTTGTGCCGCGTAAGACAGTGT CTTCTGGGGAGCTGGCCACGGTAGTACGGCCGGTTCTCCCAGACCGGCATC CAGGACTTCCTGACACTGACGCTGACGGAGCCCACTGGGCTTCGTACGT GGGCGCCCGAGAGGCCCTGTTTGCCTTCAGCATGGAGGCCCTGGAGCTGC AAGGAGCGATCTCCTGGGAGGCCCCCGTGGAGAAGAAGACTGAGTGTAT CCAGAAAGGGAAGAACAACCAGACCGAGTGCTTCAACTTCATCCGCTTCC TGCAGCCCTACAATGCCTCCCACCTGTACGTCTGTGGCACCTACGCCTTCC AGCCCAAGTGCACCTACGTCAACATGCTCACCTTCACTTTGGAGCATGGA GAGTTTGAAGATGGGAAGGGCAAGTGTCCCTATGACCCAGCTAAGGGCC ATGCTGGCCTTCTTGTGGATGGTGAGCTGTACTCGGCCACACTCAACAAC TTCCTGGGCACGGAACCCATTATCCTGCGTAACATGGGGCCCCACCACTC CATGAAGACAGAGTACCTGGCCTTTTGGCTCAACGAACCTCACTTTGTAG GCTCTGCCTATGTACCTGAGAGTGTGGGCAGCTTCACGGGGGACGACGAC AAGGTCTACTTCTTCTTCAGGGAGCGGGCAGTGGAGTCCGACTGCTATGC CGAGCAGGTGGTGGCTCGTGTGGCCCGTGTCTGCAAGGGCGATATGGGG GGCGCACGGACCCTGCAGAGGAAGTGGACCACGTTCCTGAAGGCGCGGC TGGCATGCTCTGCCCCGAACTGGCAGCTCTACTTCAACCAGCTGCAGGCG ATGCACACCCTGCAGGACACCTCCTGGCACAACACCACCTTCTTTGGGGT TTTTCAAGCACAGTGGGGTGACATGTACCTGTCGGCCATCTGTGAGTACC AGTTGGAAGAGATCCAGCGGGTGTTTGAGGGCCCCTATAAGGAGTACCA TGAGGAAGCCCAGAAGTGGGACCGCTACACTGACCCTGTACCCAGCCCTC GGCCTGGCTCGTGCATTAACAACTGGCATCGGCGCCACGGCTACACCAGC TCCCTGGAGCTACCCGACAACATCCTCAACTTCGTCAAGAAGCACCCGCT GATGGAGGAGCAGGTGGGGCCTCGGTGGAGCCGCCCCCTGCTCGTGAAG AAGGGCACCAACTTCACCCACCTGGTGGCCGACGGGTTACAGGACTTGA TGGAGCCACCTATACAGTGCTGTTCATTGGCACAGGAGACGGCTGGCTGC TCAAGGCTGTGAGCCTGGGGCCCTGGGTTCACCTGATTGAGGAGCTGCAG CTGTTTGACCAGGAGCCCATGAGAAGCCTGGTGCTATCTCAGAGCAAGAA GCTGCTCTTTGCCGGCTCCCGCTCTCAGCTGGTGCAGCTGCCCGTGGCCG ACTGCATGAAGTATCGCTCCTGTGCAGACTGTGTCCTCGCCCGGGACCCC TATTGCGCCTGGAGCGTCAACACCAGCCGCTGTGTGGCCGTGGGTGGCCA CTCTGGATCTCTACTGATCCAGCATGTGATGACCTCGGACACTTCAGGCA TCTGCAACCTCCGTGGCAGTAAGAAAGATGTACAGAAAGGTGTTCTTACA TGAAGAAGGGTGTGAAGGCTGAACAATCATGGATTTTTCTGATCAATTGT GCTTTAGGAAATTATTGACAGTTTTGCACAGGTTCTTGAAAACGTTATTTA TAATGAAATCAACTAAAACTATTTTTGCTATAAGTTCTATAAGGTGCATA AAACCCTTAAATTCATCTAGTAGCTGTTCCCCCGAACAGGTTTATTTTAGT AAAAAAAAAAAACAAAAACAAAACAAAAGATTTTTATCAAATGTTA TGATGCAAAAAAAGAAAAAGAAAAAAAAAAAGAAAAGAAAACTTCAAT TTTCTGGGTATGCACAAAGACCATGAAGACTTATCCAAGTGCATGACCGG ATTTTTGTGGTTTTGTTCATTTTGTGTTTAATTTGTGTTTTTTTTTCCAGCT GTATGAAATGGGCTTTCTGAAGTTTAAATAGTCCGACTTCACCCATGGTG TTCTGTGCTTGCAGTGCGAGTGTTGCTGTAATTCAGTGTTGCCGTCAGTGT CTCTTTTCTTAGCTTTCTGTCTTTCTTTCAACGTAGTGTGAAGTGTCTTATC CTTTTCTATGAATTCCAATTTGCCTTAACTCTTTTGATGCTGTAGCTGTTTC AGTAAAAGTTAGTTCAAACTAATGATGTAGAATGCTTTGACCAAATGAGC TGGTCTATTATGCCTTGTAAAACAGCAGCATAGGGCTTTTAAAAGGTAGT CAATAAAAGTTGCTGAAATTTTGGCTTTTTTAAATATGTAGTAGGTGTTTT TAATGATTTTTCACATAATGTGTAAGGTAGTGAAATGCAAGAAGGGAAA AATGTTTTGTGTGAAACACATTTTCTGACTGGGGAACTTTTATTAGGGTAA ATTGTTTGTAAGGCTGTACGCCAACAGTTTCCTCTGATAGTTTGACTGATT TAGGATATCTGCTGTATGATGCAATGTAAAGTCTTTTTTGCCTTTTTTCAG GAAAAAAAAAAAGCTAACTTGATGTACTAGATTTAGTGTAGGTAGTGTTG GGGTTGGGATGGGGTGGGGAGGGGAGTCACTGAATGTTTTGTCCTTC CTTTATACTAATGATAGTGCTTTAGAATGAGAATTATGCCTGAAATCTGG CAAACCGAAAAATGTTGCTATTGCAACAAAGTGGCAAAAGCTAAAAGTA | SEQ ID NO: 3 |

TABLE B-continued

| Gene Fusion | Chimera Sequence | SEQ ID NO. |
|---|---|---|
| | AGGATTTATCTTCAAACATAAGCTGAGATAACGAATAGAAGCAAAACGA<br>TTGGCTACTAGCTCTCTCTCTCTCTCTATTAGGTAAATTTGAAAAATAA<br>AAATGACTTGGCACTTTTAAAGGTAACTTCACCAAAGACCGAAGAGCCA<br>GTAACCAGTAGCTCCAACTTGTCTCAGCATCACATCTTCTGTGCTCTTTAT<br>TTTTGCCGGACCAGTTTGCGGTTAGGAGAATGTGCCTTTTTTGTACCTTTG<br>CATTTAGGTTTTATAATTTTAATTGATGTATGGACACACACAAACAAAAA<br>AGCATGAAGGAAGATTTGGATCCAAGCAGTGCCACACTTTACATCATCAC<br>TACAAGTGTTCAAGTGTAAAGAAAACCAATTTTGAAACTATGAAATTCCT<br>GATTCATAAATACACAGTTATTTCTACTTTAGTACATATAAGATAATTCAC<br>TGTTATTAAAGCTCTTTTATTAAGGCAATTGCATATGTTTTAAAAGCAATG<br>GTAAATTAAGTTGTCTTCCAAAACTGTGTACTTGTCTGGTCAGCTGTGTAT<br>GATCAGTTATCTACCTCAGAGTCTATTTTCTTTTGTGCTGGGACAGGTTGC<br>TGGCCCTCCCTGTTTCCACAGACCAAATCCTCCTAGCTCAGGAGCTAGGG<br>CTAAGCAGTTATTTCTTTCAAGTATTTTTTAGTTCTTAAATTTTATGCTTGT<br>ATTTGATGATAGATGTCAGTGACATTTCATAGTTTCAAAAGTCCTTGCTGC<br>TCTGAGAAGTGTAGATTCAGTGAAAATTACATAGTCATAAGAGAAATGT<br>GTTTTTGTTTTGTTTTGTTTCATTTTTTTAAAGTTGTGGTATTATTGGTTC<br>TATGCTCCCTGGAATATTACTGCTTTGTGAAAGTCCAGACTGAACGCAGC<br>ACCCTCTGTGTACCTAGTACAGTTATAAACCTGGGTCTCTCACTACTTGAT<br>ATTTTTGCATTAGTTAAGACAGAAATTTGATAGCTCGGTTAGAGGGGAGG<br>GGAAATCTGCTGCTAGAAATGTCTGAACTAAGTGCCATACTCGTCTGGGT<br>AAGATTTGGGAAACATAACCTCTGTACATAAAAAAAAAAAAAATCAGTTA<br>AACATCACATAGTAGACAGCCATTAAATTATAAAAAATTAATTTATGAA<br>GAAAGACCTTTTGTACAGATTGAAAAAAAAAGATTTTCATAGAGATATCT<br>ATATGATCAAGAGAGTTAATTTTTATTTTTGTTTTACTAGTGCCACAGAC<br>TTGCCAGTGGTAACTTATTTGTCCGGTTCAAGTAACTCTGTAGTTTTCTT<br>TCCTAGGACTTGTTGTTAAACGCCAAAAGACATTTTTGAACTGTACATTTG<br>ATCAGATTGTTAGCTTTTCTGTTTTATTTCTTTTGAGAACCTTTGAATAAA<br>AAACATCTGAAATTTTA | |
| TRPS1-><br>EIF3H | TAATAGTGTTGGTGTCTTGAAACTGACGTAATGCGCGGAGACTGAGGTCC<br>TGACAAGCGATAAACATTTCTGATAAAGACCCGATCTTACTGCAATCTCTA<br>GCGTCCTCTTTTTTGGTGCTGCTGGTTTCTCCAGACCTCGCGTCCTCTCGA<br>TTGCTCTCTCGCCTTCCTATTTCTTTTTTTTTTTTTAAACAAAAAACAACA<br>CCCCCTCCCCTCTCCCACCCGGCACCGGGCACATCCTTGCTCTATTTCCTT<br>TCTCTTTCTCTCTCTCTCTCTCTCTCTTTTTTAATAAGGGTGGGGGAG<br>GGAAAGGGGGGGAGGCAGGAAAGACCTTTTTCTCTCCCCCCCGCAATA<br>ATCCAAGATCAACTCTGCAAACAACAGAAGACGGTTCATGGCTTTGGCCG<br>CCGCGCCACCATCTTTCGGGCTGCCGAGGGTGTTCTTGACGATTAATCAA<br>CAGTCCAATATCAGATGGAAATGATGCGGAGCCTTCGCCATGTAAACATT<br>GATCATCTTCACGTGGGCTGGTATCAGTCCACATACTATGGCTCATTCGTT<br>ACCCGGGCACTCCTGGACTCTCAGTTTAGTTACCAGCATGCCATTGAAGA<br>ATCTGTCGTTCTCATTTATGATCCCATAAAAACTGCCCAAGGATCTCTCTC<br>ACTAAAGGCATACAGACTGACTCCTAAACTGATGGAAGTTTGTAAAGAA<br>AAGGATTTTTCCCCTGAAGCATTGAAAAAAGCAAATATCACCTTTGAGTA<br>CATGTTTGAAGAAGTGCCGATTGTAATTAAAAATTCACATCTGATCAATG<br>TCCTAATGTGGGAACTTGAAAAGAAGTCAGCTGTTGCAGATAAACATGA<br>ATTGCTCAGCCTTGCCAGCAGCAATCATTTGGGGAAGAATCTACAGTTGC<br>TGATGGACAGAGTGGATGAAATGAGCCAAGATATAGTTAAATACAACAC<br>ATACATGAGGAATACTAGTAAACAACAGCAGCAGAAACATCAGTATCAG<br>CAGCGTCGCCAGCAGGAGAATATGCAGCGCCAGAGCCGAGGAGAACCCC<br>CGCTCCCTGAGGAGGACCTGTCCAAACTCTTCAAACCACCACAGCCGCCT<br>GCCAGGATGGACTCGCTGCTCATTGCAGGCCAGATAAACACTTACTGCCA<br>GAACATCAAGGAGTTCACTGCCCAAAACTTAGGCAAGCTCTTCATGGCCC<br>AGGCTCTTCAAGAATACAACAACTAAGAAAAGGAAGTTTCCAGAAAAGA<br>AGTTAACATGAACTCTTGAAGTCACACCAGGGCAACTCTTGGAAGAAATA<br>TATTTGCATATTGAAAAGCACAGAGGATTCTTTAGTGTCATTGCCGATTT<br>TGGCTATAACAGTGTCTTTCTAGCCATAATAAAATAAAACAAAATCTTGA<br>CTGCTTGCTCATTTGA | SEQ ID NO: 4 |
| UCK2-><br>TMCO1 | ATGGCCGGGACAGCGAGCAGACCCTGCAGAACCACCAGCAGCCCAACG<br>GCGGCGAGCCCTTCCTTATAGGCGTCAGCGGGGAACAGCTAGCGGCAA<br>GAACATTCAGAAGATTCTCGGCCTTGCCCCTTCACGAGCCGCCACCAAGC<br>AGGCAGGTGGATTTCTTGGCCCACCACCTCCTTCTGGGAAGTTCTCTTGA | SEQ ID NO: 5 |
| RTN3-><br>ANK1 | ATGGCGGAGCCGTCGGCGGCCACTCAGTCCCATTCCATCTCCTCGTCGTC<br>CTTCGGAGCCGAGCCGTCCGCGCCCGGCGGCGGCGGGAGCCCAGGAGCC<br>TGCCCCGCCCTGGGGACGAAGAGCTGCAGCTCCTCCTGTGCGGAATGGT<br>TGAATGGCTTGCATCTGGCTTCTAAGGAAGGCCATGTGAAAATGGTGGTT<br>GAACTTCTGCACAAAGAAATCATTCTAGAAACGACAACCAAGAAGGGGA<br>ACACGGCCCTGCACATCGCTGCTCTAGCCGGGCAGGATGAGGTGGTCCGG<br>GAGCTTGTCAACTATGGAGCCAACGTCAACGCCCAGTCACAGAAAGGTTT<br>TACACCCCTGTACATGGCAGCACAAGAGAACCACTTGGAAGTGGTTAAGT<br>TTTTACTGGAAAATGGAGCTAACCAGAATGTAGCCACAGAACAGGCTTC<br>ACGCCTCTGGCGGTAGCCCTGCAGCAGGGCCATGAGAACGTCGTCGCGC<br>ACCTCATCAACTACGACACCAAGGGGAAGGTGCGCCTCCCGGCCCTGCAC<br>ATCGCGGCCCGCAACGACGACACGCGCACGGCTGCGGTGCTGCTGCAGA | SEQ ID NO: 6 |

TABLE B-continued

| Gene Fusion | Chimera Sequence | SEQ ID NO. |
|---|---|---|
| | ACGACCCCAACCCGGACGTGCTTTCCAAGACGGGATTCACGCCCCTGCAC<br>ATTGCGGCTCACTACGAGAACCTCAACGTGGCCCAGTTGCTCCTCAACAG<br>AGGAGCCAGCGTCAATTTCACACCACAGAACGGCATCACGCCACTGCAC<br>ATCGCCTCCCGCAGGGGCAACGTGATCATGGTGCGGCTGCTGCTGGATCG<br>GGGGAGCCCAGATAGAAACCAAGACCAAGGACGAATTGACACCTCTCCAC<br>TGTGCAGCTCGAAATGGGCACGTGCGAATCTCAGAGATCCTGCTGGACCA<br>CGGGGCACCAATCCAAGCCAAAACCAAGAACGGCCTGTCCCCAATTCAC<br>ATGGCGGCTCAGGGAGACCACCTCGACTGTGTCCGGCTCCTGTTGCAATA<br>CGACGCAGAGATAGACGACATCACCCTGGACCACCTGACCCCACTCCAC<br>GTGGCTGCCCACTGTGGACACCACAGGGTGGCTAAGGTCCTTCTGGATAA<br>AGGGGCCAAACCCAACTCCAGAGCCCTGAATGGCTTTACCCCCTTACACA<br>TCGCCTGCAAAAAGAACCACGTCCGTGTCATGGAGCTGCTGCTGAAGACG<br>GGAGCCTCGATCGACGCGGTCACCGAGTCTGGCCTGACACCTCTCCACGT<br>GGCCTCCTTCATGGGGCACCTTCCCATCGTGAAGAACCTCCTGCAGCGGG<br>GGGCGTCGCCCAACGTCTCCAACGTGAAAGTGGAGACCCCGCTACACAT<br>GGCAGCCAGAGCCGGGCACACGGAAGTGGCCAAATATTTACTCCAGAAC<br>AAAGCCAAAGTCAATGCCAAGGCCAAGGATGACCAGACCCCACTTCACT<br>GTGCAGCTCGCATCGGCCACACAAACATGGTGAAGCTCCTGCTGGAAAAT<br>AACGCCAACCCCAACCTGGCCACCACCGCCGGGCACACCCCCTGCACAT<br>TGCAGCCCGTGAGGGCCATGTGGAAACAGTCCTGGCCCTTCTGGAAAAG<br>GAAGCATCCCAGGCCTGCATGACCAAGAAAGGATTTACCCCTCTGCACGT<br>GGCGGCCAAGTACGGGAAGGTGCGGGTGGCAGAGCTGCTGCTGGAGCGG<br>GACGCACACCCGAATGCTGCCGGAAAAAATGGCCTGACCCCCCTGCACG<br>TGGCCGTCCATCACAACAACCTGGACATCGTCAAGCTGCTGCTTCCCCGG<br>GGCGGCTCCCCGCACAGCCCTGCCTGGAATGGCTACACCCCTTTGCACAT<br>CGCTGCCAAGCAGAACCAGGTGGAGGTGGCCCGTAGTCTGCTGCAGTAT<br>GGGGGCTCAGCAAACGCCGAGTCGGTGCAAGGTGTGACGCCCCTTCACCT<br>GGCCGCCCAGGAGGGCCACGCAGAGATGGTGGCTCTGCTGCTCTCGAAA<br>CAAGCCAATGGCAACCTGGGGAACAAGAGCGGACTCACTCCCCTCCATCT<br>GGTAGCACAAGAAGGCCACGTTCCAGTGGCAGATGTGCTGATCAAACAC<br>GGCGTCATGGTGGACGCCACCACCCGGATGGGCTACACTCCCCTCCATGT<br>GGCCAGTCACTATGGAAACATCAAGCTGGTGAAGTTTCTGCTGCAGCACC<br>AGGCAGATGTCAATGCCAAGACCAAGCTAGGATACAGCCCCCTGCACCA<br>GGCAGCCCAGCAGGGACACACAGACATCGTGACTCTGCTTCTGAAAAAC<br>GGTGCTTCCCCAAACGAGGTCAGCTCGGATGGAACCACACCTCTGGCCAT<br>AGCCAAGCGCTTGGGCTACATTTCTGTCACCGACGTGCTCAAGGTCGTCA<br>CGGATGAAACCAGTTTCGTGTTAGTCAGTGATAAGCATCGAATGAGTTTC<br>CCTGAGACAGTTGATGAGATCCTGGATGTCTCGGAAGATGAAGGGGAAG<br>AACTCATCAGCTTCAAGGCTGAGAGGCGGGATTCCAGGGATGTTGATGA<br>AGAGAAGGAGCTGCTGGATTTTGTGCCGAAGCTAGACCAAGTGGTGGAA<br>TCTCCAGCCATCCCCAGGATTCCCTGTGCCATGCCTGAGACAGTGGTGAT<br>CAGGTCAGAAGAGCAGGAGCAGGCATCTAAAGAGTATGATGAGGACTCC<br>CTCATCCCCAGCAGCCCGGCCACCGAGACCTCAGACAACATCAGCCCGGT<br>GGCCAGCCCGGTGCATACAGGGTTTCTGGTGAGCTTCATGGTTGACGCCC<br>GGGGTGGTTCCATGAGAGGAAGTCGCCACAACGGCCTGCGAGTGGTGAT<br>CCCGCCACGGACGTGCGCAGCGCCCACCCGCATCACCTGCCGCCTGGTCA<br>AGCCCCAGAAGCTCAGCACGCCGCCCCCACTGGCCGAGGAGGAGGGCCT<br>GGCCAGCAGGATCATAGCACTGGGGCCCACGGGGGCACAGTTCCTGAGC<br>CCTGTAATCGTGGAGATCCCGCACTTTGCCTCCCATGGCCGTGGAGACCG<br>CGAGCTCGTGGTTCTGAGGAGCGAAAACGGCTCCGTGTGGAAGGAGCAC<br>AGGAGCCGCTATGGAGAGAGCTACCTGGATCAGATCCTCAACGGGATGG<br>ACGAAGAGCTGGGGAGCCTGAGGAGCTAGAGAAGAAGAGGGTGTGCC<br>GAATCATCACCACCGACTTCCCGCTGTACTTCGTGATCATGTCACGGCTCT<br>GCCAGGACTACGACACCATCGGTCCCGAAGGGGGCTCCCTGAAGAGCAA<br>GCTGGTGCCCCTGGTACAGGCAACGTTCCCGGAGAATGCCGTCACCAAGA<br>GAGTGAAGCTGGCTCTGCAGGCCCAGCCTGTCCCGGATGAGCTTGTCACT<br>AAGCTCCTGGGCAACCAGGCCACATTCAGCCCCATTGTCACCGTGGAGCC<br>CCGGCGCCGGAAGTTCCACCGCCCCATTGGGCTTCGGATCCACTACCTC<br>CTTCCTGGACCGACAACCCGAGGGACAGCGGGGAGGGGAGACACCACCAG<br>CCTGCGCCTGCTTTGCAGCGTCATTGGAGGAACAGACCAAGCCCAGTGGG<br>AAGACATAACAGGAACCACCAAACTTGTATATGCCAACGAGTGCGCCAA<br>CTTCACCACCAATGTCTCTGCCAGGTTTTGGCTGTCGGACTGTCCTCGGAC<br>TGCTGAGGCTGTGAACTTTGCCACCCTGCTGTACAAAGAGCTCACTGCAG<br>TGCCCTACATGGCCAAATTCGTCATCTTTGCCAAGATGAATGACCCCCGA<br>GAGGGGCGCCTGCGCTGCTACTGCATGACAGATGATAAAGTGGACAAGA<br>CCCTGGAGCAGCATGAGAACTTCGTGGAGGTGGCCCGGAGCAGGGACAT<br>AGAGGTGTTGGAAGGAATGTCCCTGTTTGCAGAACTCTCTGGGAACCTGG<br>TGCCTGTGAAGAAAGCTGCCCAGCAGCGGAGCTTCACTTCCAGTCATTT<br>CGGGAGAACCGTCTGGCCATGCCTGTAAAGGTGAGGGACAGCAGTCGAG<br>AGCCGGAGGGTCCCTGTCGTTTCTGCGCAAGGCGATGAAGTACGAGGA<br>CACCCAGCACATTCTCTGCCACCTGAACATCACCATGCCCCCTGCGCCA<br>AGGGAAGTGGAGCCGAAGATAGGAGAAGGACCCCGACGCCCTGGCCCT<br>GCGATACAGCATTCTCAGTGAGTCCACACCAGGTTCTCTCAGTGGGACAG<br>AGCAGGCAGAGATGAAGATGGCTGTTATCTCAGAGCACCTCGGTCTCAGC<br>TGGGCAGAGTTGGCCCGGGAGCTGCAGTTCAGTGTGGAAGACATCAACA<br>GGATCCGAGTGGAAATCCCAACTCCCTGTTGGAGCAGAGTGTGGCCTTG<br>CTGAACCTCTGGGTCATCCGTGAAGGCCAAAACGCAAACATGGAGAATC | |

TABLE B-continued

| Gene Fusion | Chimera Sequence | SEQ ID NO. |
|---|---|---|
| | TGTACACAGCCCTGCAGAGCATTGACCGTGGCGAGATCGTGAACATGCTG<br>GAGGGTTCCGGCCGACAGAGCCGCAACTTGAAGCCAGACAGGCGGCACA<br>CCGACCGCGACTACTCGCTGTCACCCTCCCAGATGAATGGTTACTCCTCA<br>CTGCAGGACGAGCTGCTGTCCCCTGCCTCCCTGGGCTGTGCACTTTCCTCT<br>CCGCTACGTGCAGACCAGTACTGGAATGAGGTGGCCGTCCTAGACGCCAT<br>CCCCTTGGCGGCCACGGAGCATGACACCATGCTGGAGATGTCTGACATGC<br>AGGTGTGGTCTGCGGGCCTCACGCCTTCTCTGGTCACTGCTGAGGACTCC<br>TCTCTGGAGTGTAGCAAGGCTGAGGACTCTGATGCCACAGGTCACGAGTG<br>GAAGTTGGAGGGGGCACTCTCAGAGGAACCGCGGGGCCCCGAGTTGGGC<br>TCTCTGGAACTTGTGGAGGACGACACAGTGGATTCAGATGCCACAAATGG<br>CCTTATCGATTTGCTTGAACAGGAGGAAGGTCAGAGGTCAGAAGAGAAG<br>CTGCCAGGTTCTAAGAGGCAGGATGACGCGACAGGTGCAGGGCAGGACT<br>CAGAGAATGAAGTGTCTCTTGTTTCAGGCCATCAGAGGGGGCAAGCCCG<br>AATCACACATTCCCCCACCGTGAGTCAGGTGACGGAGAGGAGTCAGGAC<br>AGACTGCAGGACTGGGATGCAGACGGCTCGATTGTCTCATACCTGCAAGA<br>TGCTGCACAAGGTTCCTGGCAAGAGGAGGTCACGCAAGGTCCACACTCAT<br>TCCAGGGAACAAGTACCATGACTGAAGGGCTAGAGCCCGGTGGATCTCA<br>GGAGTACGAGAAGGTCCTGGTGTCTGTAAGTGAGCACACGTGGACAGAA<br>CAGCCCGAGGCTGAGAGCTCCCAGGCCGACAGGGACCGGAGGCAGCAAG<br>GCCAAGAAGAGCAGGTGCAGGAGGCCAAGAACACCTTCACCCAAGTGGT<br>GCAGGGGAATGAGTTTCAGAATATTCCAGGGGAGCAGGTGACAGAGGAG<br>CAATTCACGGATGAGCAGGGCAACATTGTCACCAAGAAGATCATTCGCA<br>AGGTGGTTCGACAGATAGACTTGTCCAGCGCCGATGCCGCCCAGGAGCA<br>CGAGGAGGTGGAGCTGAGAGGGAGTGGCCTACAGCCGGACCTGATAGAG<br>GGCAGGAAGGGGGCGCAGATAGTGAAGCGGGCCAGCCTGAAAAGGGGG<br>AAACAGTGA | |
| ACACA-><br>MSI2 | ATGTGGTGGTCTACTCTGATGTCAATCTTGAGGGCTAGGTCTTTCTGGAA<br>GTGGATATCTACTCAGACAGTAAGAATTATAAGAGCTGTAAGAGCTCATT<br>TTGGAGGAATAATGGATGAACCATCTCCCTTGGCCCAACCTCTGGAGCTG<br>AACCAGCACTCTCGATTCATAATAGGTTCTGTGTCTGAAGATAACTCAGA<br>GGATGAGATCAGCAACCTGGTGAAGTTGGACCTACTGGAGGAGAAGGAG<br>GGCTCCTTGTCACCTGCTTCTGTTGGCTCAGATACACTCTCTGATTTGGGG<br>ATCTCTAGCCTACAGGATGGCTTGGCCTTGCACATAAGGTCCAGCATGTC<br>TGGCTTGCACCTAGTAAAGCAGGGCCGAGACAGAAAGAAAATAGATTCT<br>CAACGAGATTTCACTGTGGCTTCTCCAGCAGAATTTGTTACTCGCTTTGGG<br>GGAAATAAAGTGATTGAGAAGGTTCTTATTGCTAACAATGGCATTGCAGC<br>AGTGAAATGCATGCGGTCTATCCGTAGGTGGTCTTATGAAATGTTTCGAA<br>ATGAACGTGCAATTAGATTCGTTGTCATGGTCACACCTGAAGACCTTAAA<br>GCCAATGCAGAATACATTAAGATGGCAGATCACTATGTGCCAGTGCCTGG<br>AGGACCAAACAACAACAACTATGCAAATGTGGAATTAATTCTTGATATTG<br>CTAAAAGGATCCCAGTACAAGCAGTGTGGGCTGGCTGGGTCATGCTTCT<br>GAGAATCCAAACTACCGGAACTTCTCTTGAAAAATGGCATTGCCTTCAT<br>GGGTCCTCCAAGCCAGGCCATGTGGGCTTTAGGGGATAAGATTGCATCTT<br>CCATAGTGGCTCAAACTGCAGGTATCCCAACTCTTCCCTGGAGCGGCAGT<br>GGTCTTCGTGTGGACTGGCAGGAAAATGATTTTTCAAAACGTATCTTAAA<br>TGTTCCCCAGGAGCTATATGAAAAAGGTTATGTGAAAGATGTGGATGATG<br>GGCTACAGGCAGCTGAGGAAGTTGGATATCCAGTAATGATCAAGGCCTC<br>AGAGGGAGGAGGAGGGAAGGGAATTAGAAAAGTCAACAATGCAGATGA<br>CTTCCCTAATCTCTTCAGACAGGTTCAAGCTGAAGTTCCTGGATCTCCCAT<br>ATTTGTGATGAGACTAGCCAAACAATCTCGTCATCTGGAGGTGCAGATCT<br>TAGCGGACCAATATGGCAATGCTATCTCTTTGTTTGGTCGTGATTGCTCTG<br>TACAACGCAGGCATCAGAAGATTATTGAAGAAGCACCTGCTACTATTGCT<br>ACTCCAGCAGTATTTGAACACATGGAACAGTGTGCGGTGAAACTTGCCAA<br>AATGGTGGGTTATGTGAGTGCTGGGACTGTGGAATACCTGTACAGCCAGG<br>ATGGCAGCTTCTACTTTCTGGAATTGAATCCTCGGCTGCAGGTAGAGCAC<br>CCTTGTACAGAGATGGTGGCTGATGTCAATCTCCCTGCAGCACAGCTCCA<br>GATTGCCATGGGGATTCCTCTATATAGAATCAAGGATATCCGTATGATGT<br>ATGGGGTATCTCCCTGGGGTGATTCTCCCATTGATTTTGAAGATTCTGCAC<br>ACGTTCCTTGTCCAAGGGGCCATGTTATTGCTGCTCGGATCACTAGTGAA<br>AATCCAGATGAGGGTTTTAAGCCCAGCTCAGGAACAGTTCAGGAGCTAA<br>ATTTCCGCAGCAATAAGAATGTTTGGGGATATTTCAGTGTTGCTGCTGCA<br>GGGGGACTTCATGAATTTGCTGATTCTCAGTTTGGTCACTGCTTTTCTTGG<br>GGAGAAAACAGAGAAGAGGCAATTTCAAACATGGTGGTGGCTTTGAAGG<br>AGCTGTCTATTCGGGGTGACTTTCGAACTACAGTTGAATACCTGATCAAA<br>TTGTTAGAGACTGAAAGCTTTCAGATGAACAGAATTGATACTGGCTGGCT<br>GGACAGACTGATAGCAGAAAAGTACAGGCTGAGCGACCTGACACCATG<br>TTGGGGGTTGTGTGGTGCCCTCCACGTGGCAGATGTGAGCCTGCGGAA<br>TAGCGTCTCTAACTTCCTTCACTCCTTAGAAAGGGGTCAAGTCCTTCCTGC<br>TCATACACTTCTGAATACAGTAGATGTTGAACTTATCTATGAGGGAGTCA<br>AGTATGTACTTAAGGTGACTCGACAGTCCCCAACTCCTATGTGGTGATC<br>ATGAATGGCTCATGTGTAGAAGTAGATGTACATCGGCTGAGTGACCTGGG<br>ACTGCTCTTGTCCTATGATGGCAGCAGTTATACTACGTATATGAAAGAGG<br>AAGTGGATAGATATCGCATCACAATTGGCAATAAAACCTGTGTGTTTGAG<br>AAGGAAAATGACCCATCGGTGATGCGCTCACCTTCTGCTGGGAAGTTAAT<br>CCAGTACATTGTAGAAGATGGAGGTCATGTGTTTGCCGGCCAGTGCTATG<br>CTGAGATTGAGGTAATGAAGATGGTAATGACCTTAACAGCTGTGGAGTCT | SEQ ID NO: 7 |

TABLE B-continued

| Gene Fusion | Chimera Sequence | SEQ ID NO. |
|---|---|---|
| | GGCTGTATCCATTACGTCAAGCGACCTGGAGCAGCTCTTGACCCTGGCTG<br>TGTACTAGCCAAAATGCAACTGGACAACCCCAGCAAGGTTCAGCAGGCT<br>GAACTTCACACAGGTAGTCTGCCACGGATCCAGAGCACGGCACTCAGAG<br>GCGAGAAACTCCATCGAGTGTTCCATTATGTCCTGGATAATCTGGTCAAT<br>GTAATGAATGGATACTGCCTTCCAGATCCTTTCTTTAGCAGCAAGGTAAA<br>AGACTGGGTAGAGCGATTGATGAAAACCCTCAGAGATCCCTCCCTGCCTC<br>TCCTAGAATTGCAAGATATTATGACCAGTGTGTCTGGCCGCATTCCCCCC<br>AATGTGGAGAAGTCTATCAAGAAGGAAATGGCTCAGTATGCTAGCAACA<br>TCACATCAGTCCTCTGTCAGTTTCCCAGCCAGCAGATTGCAAACATCCTA<br>GATAGCCATGCAGCTACATTGAACCGGAAATCTGAACGGGAAGTCTTCTT<br>TATGAATACTCAGAGCATTGTTCAGCTGGTACAGAGGTACCGAAGTGGCA<br>TCCGAGGCCACATGAAGGCTGTGGTGATGGATCTGCTCCGGCAGTACCTG<br>CGAGTAGAGACACAATTCCAGAATGGTCACTATGACAAATGTGTATTCGC<br>CCTCCGAGAAGAGAATAAAAGTGACATGAACACTGTACTGAACTACATC<br>TTCTCTCACGCTCAAGTCACCAAGAAGAATCTTCTGGTCACAATGCTTATT<br>GATCAGTTGTGTGGCCGGGACCCTACTCTCACTGATGAGCTGCTGAATAT<br>TCTCACAGAGCTAACTCAACTCAGTAAGACCACCAATGCCAAAGTAGCAC<br>TTCGAGCACGCCAGGTTCTTATTGCCTCCCATTTGCCATCATATGAGCTTC<br>GCCATAACCAAGTAGAGTCTATCTTCCTATCAGCTATTGACATGTATGGA<br>CATCAATTTTGCATTGAGAACCTGCAGAAACTCATCCTATCAGAAACATC<br>TATTTTTGATGTCCTACCAAACTTCTTCTATCACAGCAACCAAGTAGTGAG<br>GATGGCAGCTCTGGGAGGTGTATGTTCGAAGGGCTTATATTGCCTATGAAC<br>TTAACAGCGTACAACACCGCCAGCTTAAGGACAACACCTGTGTGGTGGA<br>ATTCCAGTTCATGCTGCCCACATCTCATCCAAACAGAGGGAACATCCCTA<br>CGCTAAACAGAATGTCCTTCTCCTCCAACCTCAACCACTATGGCATGACC<br>CATGTAGCTAGTGTCAGCGATGTACTGTTGGACAACTCATTCACTCCACC<br>TTGTCAGCGGATGGGCGGAATGGTCTCTTTTCGGACTTTTGAAGATTTTGT<br>CAGGATCTTTGATGAAGTGATGGGCTGCTTCTCTGACTCCCCACCCCAGA<br>GTCCCACATTCCCTGAGGCAGGTCACACGTCTCTTTATGATGAGGATAAG<br>GTTCCCAGGGATGAACCAATTCACATTCTCAATGTGGCTATCAAGACTGA<br>CTGTGATATTGAGGATGACAGGCTGGCAGCTATGTTCAGAGAATTTACCC<br>AGCAAAATAAAGCTACCCTGGTTGACCATGGGATCCGGCGCCTTACTTTC<br>CTGGTTGCACAAAAGGATTTCAGAAAGCAGGTCAACTATGAGGTGGATC<br>GGAGATTTCATAGAGAATTCCCTAAATTTTTTACATTCCGAGCAAGGGAT<br>AAGTTTGAGGAGGATCGTATCTATCGTCATCTGGAGCCTGCTCTGGCTTTC<br>CAGTTAGAGCTGAACCGGATGAGAAATTTTGACCTCACTGCCATTCCATG<br>TGCTAATCACAAGATGCACCTGTATCTCGGGGCAGCCAAGGTGGAAGTG<br>GGCACAGAAGTGACAGACTACAGGTTCTTTGTTCGTGCAATCATCAGGCA<br>TTCTGATCTGGTCACCAAGGAAGCTTCTTTTGAATATCTGCAAAATGAAG<br>GGGAGCGGCTACTCCTGGAAGCCATGGATGAGTTGGAAGTTGCTTTTAAC<br>AATACAAATGTCCGCACTGACTGTAACCACATCTTCCTAACTTTGTGCCC<br>ACGGTTATCATGGACCCATCAAAGATTGAGGAATCCGTGCGGAGCATGGT<br>AATGCGGTATGGAAGTCGCCTGTGGAAATTGCGCGTCCTCCAGGCAGAAC<br>TGAAAATCAACATTCGCCTGACGCCAACTGGAAAAGCAATTCCCATCCGC<br>CTCTTCCTGACAAACGAGTCTGGCTATTACTTGGATATCAGCCTATACAA<br>GGAAGTGACTGACTCCAGGACAGCACAGATCATGTTTCAGGCATATGGA<br>GACAAACAGGGACCACTGCATGGAATGTTAATCAATACTCCATATGTGAC<br>CAAAGACCTGCTGCAATCAAAGAGGTTCCAGGCACAATCCTTAGGGACA<br>ACATACATATATGATATCCCAGAGATGTTTCGGCAGTCCCTGATCAAACT<br>CTGGGAGTCTATGTCCACTCAAGCATTTCTTCCATCTCCCCCTCTGCCTTC<br>TGACATGCTGACTTACACTGAACTGGTACTGGATGATCAAGGTCAGCTGG<br>TCCACATGAACAGGCTTCCAGGAGGAAATGAGATGGTCACAAGAACAAA<br>GAAAATATTTGTAGGCGGGTTATCTGCGAACACAGTAGTGGAAGATGTA<br>AAGCAATATTTCGAGCAGTTTGGCAAGGTGGAAGATGCAATGCTGATGTT<br>TGATAAAACTACCAACAGGCACAGAGGGTTTGGCTTTGTCACTTTTGAGA<br>ATGAAGATGTTGTGGAGAAAGTCTGTGAGATTCATTTCCATGAAATCAAT<br>AATAAAATGGTAGAATGTAAGAAAGCTCAGCCGAAAGAAGTCATGTTCC<br>CACCTGGGACAAGAGGCCGGGCCCGGGGACTGCCTTACACCATGGACGC<br>GTTCATGCTTGGCATGGGGATGCTGGGATATCCCAACTTCGTGGCGACCT<br>ATGGCCGTGGCTACCCCGGATTTGCTCCAAGCTATGGCTATCAGTTCCCA<br>GGCTTCCCAGCAGCGGCTTATGGACCAGTGGCAGCAGCGGCGGTGGCGG<br>CAGCAAGAGGATCAGGCTCCAACCCGGCGCGGCCCGGAGGCTTCCCGGG<br>GGCCAACAGCCCAGGACCTGTCGCCGATCTCTACGCCCTGCCAGCCAGG<br>ACTCCGGAGTGGGGAATTACATAAGTGCGGCCAGCCCACAGCCGGGCTC<br>GGGCTTCGGCCACGGCATAGCTGGACCTTTGATTGCAACGGCCTTTACAA<br>ATGGATACCATTGA | |
| DDX5-><br>IQCG | ATGTCGGGTTATTCGAGTGACCGAGACCGCGGCCGGGACCGAGGGTTTG<br>GTGCACCTCGATTTGGAGGAAGTAGGGCAGGGCCCTTATCTGGAAAGAA<br>GTTTGGAAACCCTGGGGAGAAATTAGTTAAAAGAAGTGGAATCTTGAT<br>GAGCTGCCTAAATTTGAGAAGAATTTTTATCAAGAGCACCCTGATTTGGC<br>TAGGCGCACAGCACAAGAGGTGGAAACATACAGAAGAAGCAAGGAAAT<br>TACAGTTAGAGGTCACAACTGCCCGAAGCCAGTTCTAAATTTTATGAAG<br>CCAATTTCCCTGCAAATGTCATGGATGTTATTGCAAGACAGAATTTCACT<br>GAACCCACTGCTATTCAAGCTCAGGGATGGCCAGTTGCTCTAAGTGGATT<br>GGATATGGTTGGAGTGGCACAGACTGGATCTGGGAAAACATTGTCTTATT<br>TGCTTCCTGCCATTGTCCACATCAATCATCAGCCATTCCTAGAGAGAGGC | SEQ ID NO: 8 |

TABLE B-continued

| Gene Fusion | Chimera Sequence | SEQ ID NO. |
|---|---|---|
| | GATGGGCCTATTTGTTTGGTGCTGGCACCAACTCGGGAACTGGCCCAACA GGTGCAGCAAGTAGCTGCTGAATATTGTAGAGCATGTCGCTTGAAGTCTA CTTGTATCTACGGTGGTGCTCCTAAGGGACCACAAATACGTGATTTGGAG AGAGGTGTGGAAATCTGTATTGCAACACCTGGAAGACTGATTGACTTTTT AGAGTGTGGAAAAACCAATCTGAGAAGAACAACCTACCTTGTCCTTGATG AAGCAGATAGAATGCTTGATATGGGCTTTGAACCCCAAATAAGGAAGAT TGTGGATCAAATAAGACCTGATAGGCAAACTCTAATGTGGAGTGCGACTT GGCCAAAAGAAGTAAGACAGCTTGCTGAAGATTTCCTGAAAGACTATATT CATATAAACATTGGTGCACTTGAACTGAGTGCAAACCACAACATTCTTCA GATTGTGGATGTGTGTCATGACGTAGAAAAGGATGAAAAACTTATTCGTC TAATGAAGAGATCATGAGTGAGAAGGAGAATAAAACCATTGTTTTTGT GGAAACCAAAAGAAGATGTGATGAGCTTACCAGAAAAATGAGGAGAGAT GGGTGGCCTGCCATGGGTATCCATGGTGACAAGAGTCAACAAGAGCGTG ACTGGGTTCTAAATGAATTCAAACATGGAAAAGCTCCTATTCTGATTGCT ACAGATGTGGCCTCCAGAGGGCTAGATGTGGAAGATGTGAAATTTGTCAT CAATTATGACTACCCTAACTCCTCAGAGGATTATATTCATCGAATTGGAA GAACTGCTCGCAGTACCAAAACAGGCACAGCATACACTTTCTTTACACCT AATAACATAAAGCAAGTGAGCGACCTTATCTCTGTGCTTCGTGAAGCTAA TCAAGCAATTAATCCCAAGTTGCTTCAGTTGGTCGAAGACAGAGGTTCAG AGTCAGAATGAGTATATTGCTAACCTCAAGGACCAACTGCAAGAGATGA AGGCAAAATCCAACTTGGAGAATCGCTACATGAAAACCAATACCGAGCT GCAGATTGCCCAGACCCAGAAAAAGTGTAACAGAACAGAGGAACTCTTG GTGGAAGAGATTGAGAAACTCAGGATGAAAACCGAAGAAGAGGCCCGG ACTCATACAGAGATTGAAATGTTCCTTAGAAAGGAGCAGCAGAAACTTG AGGAGAGGCTGGAGTTCTGGATGGAGAAATACGATAAGGACACAGAAAT GAAACAGAATGAACTAAATGCTCTCAAAGCCACAAAGGCCAGTGACTTA GCACACCTTCAAGACCTGGCAAAGATGATAAGAGAGTATGAACAGGTCA TCATTGAAGATCGTATAGAAAGGAGAGGAGCAAGAAGAAGGTAAAAC AGGATCTCTTGGAATTAAAGAGCGTTATAAAGCTCCAGGCCTGGTGGCGA GGCACTATGATACGGAGAGAAATTGGTGGTTTCAAGATGCCTAAAGACA AAGTTGATAGCAAGGATTCAAAAGGCAAAGGTAAAGGCAAGGATAAGA GGAGAGGCAAGAAGAAGTGA | |
| PREX1-> SLC9A8 | ATGGAGGCGCCCAGCGGCAGCGAGCCCGGCGGCGACGGGGCCGGGGACT GCGCCCACCCGGACCCCCGGGCCCCTGGCGCCGCGGCGCCCAGCTCCGG CCCCGGCCCGTGCGCGGCCGCCCGGGAGTCCGAGCGCCAGCTGCGCCTCC GCCTCTGCGTCCTCAACGAGATCTTGGGCACCGAGAGGGACTACGTGGGC ACCTTGCGCTTCTTGCAGTCGGCATTCCTGCATCGCATCCGGCAGAACGT GGCCGACTCAGTGGGAAAGGGCCTCACGGAGGAGAATGTCAAGGTCCTG TTCTCGAACATCGAAGACATCCTGGAAGTTCATAAGGATTTCTTGGCCGC CTTGGAGTATTGTTTACACCCGGAGCCGCAGTCTCAGCATGAACTTGGGA ATGTTTTCTTAAAATTCAAGGACAAGTTCTGCGTGTACGAGGAGTATTGC AGCAACATGAGAAAGCCCTGAGGCTGCTGGTGGAGCTGAACAAGATCC CTACCGTGCGCGCCTTCCTTTTGAGCTGCATGCTTCTGGGAGGCCGGAAG ACCACGGACATCCCTTTGGAAGGCTACCTGTTGTCTCCGATCCAGAGGAT CTGCAAGTACCCGCTCCTCCTTAAGGAGCTGGCCAAGAGGACTCCCGGCA AGCACCCAGACCACCCCGCGGTCCAGAGTGCCCTGCAGGCCATGAAGAC CGTTTGCTCCAACATCAATGAGACCAAGCGGCAGATGGAGAAGCTGGAA GCCCTGGAGCAGCTGCAGTCCCACATCGAAGGCTGGGAGGAGGTTCCCC AATACAACTCATGAGGGTTTCAATGTCACCCTCCACACCACCCTGGTTGT CACGACGAAACTGGTGCTCCCGACCCCTGGCAAGCCCATCCTCCCCGTGC AGACAGGGGAGCAGGCCCAGCAAGAGGAGCAGTCCAGCGGCATGACCAT TTTCTTCAGCCTCCTTGTCCTAGCTATCTGCATCATATTGGTGCATTTACTG ATCCGATACAGATTACATTCTTGCCAGAGAGTGTTGCTGTTGTTTCTTTA GGTATTCTCATGGAGCAGTTATAAAAATTATAGAGTTTAAAAAACTGGC GAATTGGAAGGAAGAAGAAATGTTTCGTCCAAACATGTTTTTCCTCCTCC TGCTTCCCCCTATTATCTTTGAGTCTGGATATTCATTACACAAGGGTAACT TCTTTCAAAATATTGGTTCCATCACCCTGTTTGCTGTTTTTGGGACGGCAA TCTCCGCTTTTGTAGTAGGTGGAGGAATTTATTTTCTGGGTCAGGCTGATG TAATCTCTAAACTCAACATGACAGACAGTTTTGCGTTTGGCTCCCTAATAT CTGCTGTCGATCCAGTGGCCACTATTGCCATTTTCAATGCACTTCATGTGG ACCCCGTGCTAACATGCTGGTCTTTGGAGAAAGTATTCTCAACGATGCA GTCTCCATTGTTCTGACCAACACAGCTGAAGGTTAACAAGAAAAAATAT GTCAGATGTCAGTGGGTGGCAAACATTTTTACAAGCCCTTGACTACTTCC TCAAAATGTTCTTTGGCTCTGCAGCGCTCGGCACTCTCACTGGCTTAATTT CTGCATTAGTGCTGAAGCATATTGACTTGAGGAAAACGCCTTCCTTGGAG TTTGGCATGATGATCATTTTTGCTTATCTGCCTTATGGGCTTGCAGAAGGA ATCTCACTCTCAGGCATCATGGCCATCCTTTCTCAGGCATCGTGATGTCC CACTACACGCACCATAACCTCTCCCCAGTCACCCAGATCCTCATGCAGCA GACCCTCCGCACCGTGGCCTTCTATGTGAAACATGTGTGTTTGCATTTCT TGGCCTGTCCATTTTTAGTTTTCCTCACAAGTTTGAAATTTCCTTTGTCATC TGGTGCATAGTGCTTGTACTATTTGGCAGAGCGGTAAACATTTTCCCTCTT TCCTACCTCCTGAATTTCTTCCGGGATCATAAAATCACACCGAAGATGAT GTTCATCATGTGGTTTAGTGGCCTGCGGGAGCCATCCCCTATGCCCTGA GCCTACACCTGGACCTGGAGCCCATGGAGAAGCGGCAGCTCATCGGCAC CACCACCATCGTCATCGTGCTCTTCACCATCCTGCTGCTGGGCGGCAGCA CCATGCCCCTCATTCGCCTCATGGACATCGAGGACGCCAAGGCACACCGC | SEQ ID NO: 9 |

TABLE B-continued

| Gene Fusion | Chimera Sequence | SEQ ID NO. |
|---|---|---|
|  | AGGAACAAGAAGGACGTCAACCTCAGCAAGACTGAGAAGATGGGCAAC<br>ACTGTGGAGTCGGAGCACCTGTCGGAGCTCACGGAGGAGGAGTACGAGG<br>CCCACTACATCAGGCGGCAGGACCTTAAGGGCTTCGTGTGGCTGGACGCC<br>AAGTACCTGAACCCCTTCTTCACTCGGAGGCTGACGCAGGAGGACCTGCA<br>CCACGGGCGCATCCAGATGAAAACTCTCACCAACAAGTGGTACGAGGAG<br>GTACGCCAGGGCCCCTCCGGCTCCGAGGACGACGAGCAGGAGCTGCTCT<br>GA |  |
| TXLNA-><br>MARCH6 | ATGAAGAACCAAGACAAAAAGAACGGGGCTGCCAAACAATCCAATCCAA<br>AAAGCAGCCCAGGACAACCGGAAGCAGGACCCCGAGGGAGCCCAGGAGC<br>GGCCCAGCCAGGCGGCTCCTGCAGTAGAAGCAGAAGGTCCCGGCAGCAG<br>CCAGGCTCCTCGGAAGCCGGAGGGGGCTCAAGCCAGAACGGCTCAGTCT<br>GGGGCCCTTCGTGATGTCTCTGAGGAGCTGAGCCGCCAACTGGAAGACAT<br>ACTGAGCACATACTGTGTGGACAATAACCAGGGGGGCCCCGGCGAGGAT<br>GGGGCACAGGGTGAGCCGGCTGAACCCGAAGATGCAGAGAAGTCCCGGA<br>CCTATGTGGCAAGGAATGGGGAGCCTGAACCAACTCCAGTAGTCAATGG<br>AGAGAAGGAACCCTCCAAGGGGGATCCAAACACAGAAGAGATCCGGCA<br>GAGTGACGAGGTCGGAGACCGAGACCATCGAAGGCCACAGGAGAAGAA<br>AAAAGCCAAGGGTTTGGGGAAGGAGATCACGTTGCTGATGCAGACATTG<br>AATACTCTGAGTACCCCAGAGGAGAAGCTGGCTGCTCTGTGCAAGAAGT<br>ATGCTGAACTGGTACCTTGTGGGTCAACGACTCGTGAACTACGAACGGAA<br>ATCTGGCAAACAAGGCTCATCTCCACCACCTCCACAGTCATCCCAAGAAT<br>AA | SEQ ID NO: 10 |
| EIF2C3-><br>ZP2 | ATGGAAATCGGCTCCGCAGGACCCGCTGGGGCCCAGCCCCTACTCATGGT<br>GCCCAGAAGACCTGGCTATGGCACCATGGGCAAACCCATTAAACTGCTG<br>GCTAACTGTTTTCAAGTTGAAATCCCAAAGATTGATGTCTACCTCTATGA<br>GGTAGATATTAAACCAGACAAGTGTCCTAGGAGAGTGAACAGGGAGGTG<br>GTTGACTCAATGGTTCAGCATTTAAAGTAACTATATTTGGAGACCGTAG<br>ACCAGTTTATGATGGAAAAAGAAGTCTTTACACCGCCAATCCACTTCCTG<br>TGGCAACTACAGGGGTAGATTTAGACGTTACTTTACCTGGGGAAGGTGGA<br>AAAGATCGACCTTTCAAGGTGTCAATCAAATTTGTCTCTCGGGTGAGTTG<br>GCACCTACTGCATGAAGTACTGACAGGACGGACCTTGCCTGAGCCACTGG<br>AATTAGACAAGCCAATCAGCACTAACCCTGTCCATGCCGTTGATGTGGTG<br>CTACGACATCTGCCCTCCATGAAATACACACCTGTGGGGCGTTCATTTTTC<br>TCCGCTCCAGAAGGATATGACCACCCTCTGGGAGGGGGCAGGGAAGTGT<br>GGTTTGGATTCCATCAGTCTGTTCGGCCTGCCATGTGGAAAATGATGCTT<br>AATATCGATGTTTCTGCCACTGCCTTCTACAAAGCACAACCTGTAATTCA<br>GTTCATGTGTGAAGTTCTTGATATTCATAATATTGATGAGCAACCAAGAC<br>CTCTGACTGATTCTCATCGGGTAAAATTCACCAAAGAGATAAAAGGTTTG<br>AAGGTTGAAGTGACTCATTGTGGAACAATGAGACGGAAATACCGTGTTTG<br>TAATGTAACAAGGAGGCCTGCCAGTCATCAAACCTTTCCTTTACAGTTAG<br>AAAACGGCCAAACTGTGGAGAGAACAGTAGCGCAGTATTTCAGAGAAAA<br>GTATACTCTTCAGCTGAAGTACCCGCACCTTCCCTGTCTGCAAGTCGGGC<br>AGGAACAGAAACACACCTACCTGCCACTAGAAGTCTGTAATATTGTGGCA<br>GGGCAACGATGTATCAAGAAGCTAACAGACAATCAGACTTCCACTATGA<br>TCAAGGCAACAGCAAGATCTGCACCAGATAGACAAGAGGGAAATTAGCAG<br>ATTGGTAAGAAGTGCAAATTATGAAACAGATCCATTTGTTCAGGAGTTTC<br>AATTTAAAGTTCGGGATGAAATGGCTCATGTAACTGGACGCGTACTTCCA<br>GCACCTATGCTCCAGTATGGAGGACGGAATCGGACAGTAGCAACACCGA<br>GCCATGGAGTATGGGACATGCGAGGGAAACAATTCCACACAGGAGTTGA<br>AATCAAAATGTGGGCTATCGCTTGTTTTGCCACACAGAGGCAGTGCAGAG<br>AAGAAATATTGAAGGGTTTCACAGACCAGCTGCGTAAGATTTCTAAGGAT<br>GCAGGGATGCCCATCCAGGGCCAGCCATGCTTCTGCAAATATGCACAGG<br>GGGCAGACAGCGTAGAGCCCATGTTCCGGCATCTCAAGAACACATATTCT<br>GGCCTACAGCTTATTATCGTCATCCTGCCGGGGAAGACACCAGTGTATGA<br>TAATTCCTACCAACAACCTTATGGGGAAAACGAGTACCCTCTAGTGAGAT<br>TCCTCCGCAACCAATTTACATGGAAGTGAGAGTCCTAAACAGGGATGAC<br>CCCAACATCAAGCTGGTCTTAGATGACTGCTGGGCGACGTCCACCATGGA<br>TCCAGACTCTTTCCCCCAGTGGAACGTTGTCGTGGATGGCTGTGCATATG<br>ACCTGGACAACTACCAGACCACCTTCCATCCAGTCGGCTCCTCTGTGACC<br>CATCCTGATCACTATCAGAGGTTTGACATGAAGGCTTTTGCCTTTGTATCA<br>GAAGCCCACGTGCTCTCTAGCCTGGTCTACTTCCACTGCAGTGCCTTAATC<br>TGTAATCGACTCTCCCCTGACTCCCCACTGTGTTCTGTGACCTGCCCTGTG<br>TCCTCTAGGCACAGGCGAGCCACAGGGGCCACTGAAGCAGAGAAAATGA<br>CAGTCAGCCTCCCAGGACCCATTCTCCTGTTGTCAGATGACTCCTCATTCA<br>GAGGTGTCGGCTCATCTGATCTAAAAGCAAGTGGGAGCAGTGGGGAGAA<br>GAGTAGGAGTGAAACAGGGGAGGAGGTTGGCTCACGAGGTGCTATGGAC<br>ACCAAAGGGCACAAGACTGCTGGAGATGTTGGTTCCAAAGCTGTGGCTG<br>CTGTGGCTGCCTTTGCAGGTGTGGTGGCAACTCTAGGCTTCATCTACTACC<br>TGTACGAGAAAAGGACTGTGTCAAATCACTAA | SEQ ID NO: 11 |
| TPP2-><br>BRCA2 | ATGGCCACCGCTGCGACTGAGGAGCCCTTCCCTTTTCACGGTCTCCTGCC<br>GAAGAAGGAGACCGGAGCCGCCTCCTTCCTCTGCCGCTACCCGGAGTATG<br>ATGGGCGGGGGTGCTCATCGCAGTCCTGGACACGGGGTCGACCCGGG<br>GGCTCCGGGCATGCAGATGCCTATTGGATCCAAAGAGAGGCAACATTTT<br>TTGAAATTTTTAAGACACGCTGCAACAAAGCAGATTTAGGACCAATAAGT | SEQ ID NO: 12 |

TABLE B-continued

| Gene Fusion | Chimera Sequence | SEQ ID NO. |
|---|---|---|
| | CTTAATTGGTTTGAAGAACTTTCTTCAGAAGCTCCACCCTATAATTCTGAA<br>CCTGCAGAAGAATCTGAACATAAAAACAACAATTACGAACCAAACCTAT<br>TTAAAACTCCACAAAGGAAACCATCTTATAATCAGCTGGCTTCAACTCCA<br>ATAATATTCAAAGAGCAAGGGCTGACTCTGCCGCTGTACCAATCTCCTGT<br>AAAAGAATTAGATAAAATTCAAATTAGACTTAGGAAGGAATGTTCCCAAT<br>AGTAGACATAAAAGTCTTCGCACAGTGAAAACTAAAATGGATCAAGCAG<br>ATGATGTTTCCTGTCCACTTCTAAATTCTTGTCTTAGTGAAAGTCCTGTTG<br>TTCTACAATGTACACATGTAACACCACAAAGAGATAAGTCAGTGGTATGT<br>GGGAGTTTGTTTCATACACCAAAGTTTGTGAAGGGTCGTCAGACACCAAA<br>ACATATTTCTGAAAGTCTAGGAGCTGAGGTGGATCCTGATATGTCTTGGT<br>CAAGTTCTTTAGCTACACCACCCACCCTTAGTTCTACTGTGCTCATAGTCA<br>GAAATGAAGAAGCATCTGAAACTGTATTTCCTCATGATACTACTGCTAAT<br>GTGAAAAGCTATTTTCCAATCATGATGAAAGTCTGAAGAAAAATGATAG<br>ATTTATCGCTTCTGTGACAGACAGTGAAAACACAAATCAAAGAGAAGCT<br>GCAAGTCATGGATTTGGAAAAACATCAGGGAATTCATTTAAAGTAAATA<br>GCTGCAAAGACCACATTGGAAAGTCAATGCCAAATGTCCTAGAAGATGA<br>AGTATATGAAACAGTTGTAGATACCTCTGAAGAAGATAGTTTTTCATTAT<br>GTTTTTCTAAATGTAGAACAAAAAATCTACAAAAAGTAAGAACTAGCAA<br>GACTAGGAAAAAAATTTTCCATGAAGCAAACGCTGATGAATGTGAAAAA<br>TCTAAAAACCAAGTGAAAGAAAAATACTCATTTGTATCTGAAGTGGAACC<br>AAATGATACTGATCCATTAGATTCAAATGTAGCAAATCAGAAGCCCTTTG<br>AGAGTGGAAGTGACAAAATCTCCAAGGAAGTTGTACCGTCTTTGGCCTGT<br>GAATGGTCTCAACTAACCCTTTCAGGTCTAAATGGAGCCCAGATGGAGAA<br>AATACCCCTATTGCATATTTCTTCATGTGACCAAAATATTTCAGAAAAAG<br>ACCTATTAGACACAGAGAACAAAAGAAAGAAAGATTTTCTTACTTCAGA<br>GAATTCTTTGCCACGTATTTCTAGCCTACCAAAATCAGAGAAGCCATTAA<br>ATGAGGAAACAGTGGTAAATAAGAGAGATGAAGAGCAGCATCTTGAATC<br>TCATACAGACTGCATTCTTGCAGTAAAGCAGGCAATATCTGGAACTTCTC<br>CAGTGGCTTCTTCATTTCAGGGTATCAAAAAGTCTATATTCAGAATAAGA<br>GAATCACCTAAAGAGACTTTCAATGCAAGTTTTTCAGGTCATATGACTGA<br>TCCAAACTTTAAAAAAGAAACTGAAGCCTCTGAAAGTGGACTGGAAATA<br>CATACTGTTTGCTCACAGAAGGAGGACTCCTTATGTCCAAATTTAATTGA<br>TAATGGAAGCTGGCCAGCCACCACCACACAGAATTCTGTAGCTTTGAAGA<br>ATGCAGGTTTAATATCCACTTTGAAAAAGAAAACAAATAAGTTTATTTAT<br>GCTATACATGATGAAACATCTTATAAAGGAAAAAAAAATACCGAAAGACC<br>AAAAATCAGAACTAATTAACTGTTCAGCCCAGTTTGAAGCAAATGCTTTT<br>GAAGCACCACTTACATTTGCAAATGCTGATTCAGGTTTATTGCATTCTTCT<br>GTGAAAAGAAGCTGTTCACAGAATGATTCTGAAGAACCAACTTTGTCCTT<br>AACTAGCTCTTTTGGGACAATTCTGAGGAAATGTTCTAGAAATGAAACAT<br>GTTCTAATAATACAGTAATCTCTCAGGATCTTGATTATAAAGAAGCAAAA<br>TGTAATAAGGAAAAACTACAGTTATTTATTACCCCAGAAGCTGATTCTCT<br>GTCATGCCTGCAGGAAGGACAGTGTGAAAATGATCCAAAAAGCAAAAAA<br>GTTTCAGATATAAAAGAAGAGGTCTTGGCTGCAGCATGTCACCCAGTACA<br>ACATTCAAAAGTGGAATACAGTGATACTGACTTTCAATCCCAGAAAAGTC<br>TTTTATATGATCATGAAAATGCCAGCACTCTTATTTTAACTCCTACTTCCA<br>AGGATGTTCTGTCAAACCTAGTCATGATTTCTAGAGGCAAAGAATCATAC<br>AAAATGTCAGACAAGCTCAAAGGTAACAATTATGAATCTGATGTTGAATT<br>AACCAAAAATATTCCCATGGAAAAGAATCAAGATGTATGTGCTTTAAATG<br>AAAATTATAAAACGTTGAGCTGTTGCCACCTGAAAATACATGAGAGT<br>AGCATCACCTTCAAGAAAGGTACAATTCAACCAAAACACAAATCTAAGA<br>GTAATCCAAAAAAATCAAGAAGAAACTACTTCAATTTCAAAAATAACTGT<br>CAATCCAGACTCTGAAGAACTTTCTCAGACAATGAGAATAATTTTGTCT<br>TCCAAGTAGCTAATGAAAGGAATAATCTTGCTTTAGGAAATACTAAGGAA<br>CTTCATGAAACAGACTTGACTTGTGTAAACGAACCCATTTTCAAGAACTC<br>TACCATGGTTTTATATGGAGACAGGTGATAAACAAGCAACCCAAGTGT<br>CAATTAAAAAAGATTTGGTTTATGTTCTTGCAGAGGAGAACAAAAATAGT<br>GTAAAGCAGCATATAAAAATGACTCTAGGTCAAGATTTAAAATCGGACA<br>TCTCCTTGAATATAGATAAAATACCAGAAAAAAATAATGATTACATGAAC<br>AAATGGGCAGGACTCTTAGGTCCAATTTCAAATCACAGTTTTGGAGGTAG<br>CTTCAGAACAGCTTCAAATAAGGAAATCAAGCTCTCTGAACATAACATTA<br>AGAAGAGCAAAATGTTCTTCAAAGATATTGAAGAACAATATCCTACTAGT<br>TTAGCTTGTGTTGAAATTGTAAATACCTTGGCATTAGATAATCAAAAGAA<br>ACTGAGCAAGCCTCAGTCAATTAATACTGTATCTGCACATTTACAGAGTA<br>GTGTAGTTGTTTCTGATTGTAAAAATAGTCATATAACCCCTCAGATGTTAT<br>TTTCCAAGCAGGATTTTAATTCAAACCATAATTTAACACCTAGCCAAAAG<br>GCAGAAATTACAGAACTTTCTACTATATTAGAAGAATCAGGAAGTCAGTT<br>TGAATTTACTCAGTTTAGAAAACCAAGCTACATATTGCAGAAGAGTACAT<br>TTGAAGTGCCTGAAAACCAGATGACTATCTTAAAGACCACTTCTGAGGAA<br>TGCAGAGATGCTGATCTTCATGTCATAATGAATGCCCCATCGATTGGTCA<br>GGTAGACAGCAGCAAGCAATTTGAAGGTACAGTTGAAATTAAACGGAAG<br>TTTGCTGGCCTGTTGAAAAATGACTGTAACAAAAGTGCTTCTGGTTATTTA<br>ACAGATGAAAATGAAGTGGGGTTTAGGGGCTTTTATTCTGCTCATGGCAC<br>AAAACTGAATGTTTCTACTGAAGCTCTGCAAAAAGCTGTGAAACTGTTTA<br>GTGATATTGAGAATATTAGTGAGGAACTTCTGCAGAGGTACATCCAATA<br>AGTTTATCTTCAAGTAAATGTCATGATTCTGTTGTTTCAATGTTTAAGATA<br>GAAAATCATAATGATAAAACTGTAAGTGAAAAAATAATAAATGCCAAC<br>TGATATTACAAAATAATATTGAAATGACTACTGGCACTTTTGTTGAAGAA | |

TABLE B-continued

| Gene Fusion | Chimera Sequence | SEQ ID NO. |
|---|---|---|
| | ATTACTGAAAATTACAAGAGAAATACTGAAAATGAAGATAACAAATATA<br>CTGCTGCCAGTAGAAATTCTCATAACTTAGAATTTGATGGCAGTGATTCA<br>AGTAAAAATGATACTGTTTGTATTCATAAAGATGAAACGGACTTGCTATT<br>TACTGATCAGCACAACATATGTCTTAAATTATCTGGCCAGTTTATGAAGG<br>AGGGAAACACTCAGATTAAAGAAGATTTGTCAGATTTAACTTTTTTGGAA<br>GTTGCGAAAGCTCAAGAAGCATGTCATGGTAATACTTCAAATAAAGAAC<br>AGTTAACTGCTACTAAAACGGAGCAAAATATAAAGATTTTGAGACTTCT<br>GATACATTTTTTCAGACTGCAAGTGGGAAAAATATTAGTGTCGCCAAAGA<br>GTCATTTAATAAAATTGTAAATTTCTTTGATCAGAAACCAGAAGAATTGC<br>ATAACTTTTCCTTAAATTCTGAATTACATTCTGACATAAGAAAGAACAAA<br>ATGGACATTCTAAGTTATGAGGAAACAGACATAGTTAAACACAAAATAC<br>TGAAAGAAAGTGTCCCAGTTGGTACTGGAAATCAACTAGTGACCTTCCAG<br>GGACAACCCGAACGTGATGAAAAGATCAAAGAACCTACTCTATTGGGTTT<br>TCATACAGCTAGCGGGAAAAAAGTTAAAATTGCAAAGGAATCTTTGGAC<br>AAAGTGAAAAACCTTTTTGATGAAAAAGAGCAAGGTACTAGTGAAATCA<br>CCAGTTTTAGCCATCAATGGGCAAGACCCTAAAGTACAGAGAGGCCTGT<br>AAAGACCTTGAATTAGCATGTGAGACCATTGAGATCACAGCTGCCCCAAA<br>GTGTAAAGAAATGCAGAATTCTCTCAATAATGATAAAAACCTTGTTTCTA<br>TTGAGACTGTGGTGCCACCTAAGCTCTTAAGTGATAATTTATGTAGACAA<br>ACTGAAAATCTCAAACATCAAAAGTATCTTTTTGAAAGTTAAAGTACA<br>TGAAAATGTAGAAAAAGAAACAGCAAAAAGTCCTGCAACTTGTTACACA<br>AATCAGTCCCCTTATTCAGTCATTGAAAATTCAGCCTTAGCTTTTTACACA<br>AGTTGTAGTAGAAAAACTTCTGTGAGTCAGACTTCATTACTTGAAGCAAA<br>AAAATGGCTTAGAGAAGGAATATTTGATGGTCAACCAGAAAGAATAAAT<br>ACTGCAGATTATGTAGGAAATTATTTGTATGAAAATAATTCAAACAGTAC<br>TATAGCTGAAAATGACAAAAATCATCTCTCCGAAAAACAAGATACTTATT<br>TAAGTAACAGTAGCATGTCTAACAGCTATTCCTACCATTCTGATGAGGTA<br>TATAATGATTCAGGATATCTCTCAAAAAATAAACTTGATTCTGGTATTGA<br>GCCAGTATTGAAGAATGTTGAAGATCAAAAAAACACTAGTTTTTCCAAAG<br>TAATATCCAATGTAAAAGATGCAAATGCATACCCACAAACTGTAAATGA<br>AGATATTTGCGTTGAGGAACTTGTGACTAGCTCTTCACCCTGCAAAAATA<br>AAAATGCAGCCATTAAATTGTCCATATCTAATAGTAATAATTTTGAGGTA<br>GGGCCACCTGCATTTAGGATAGCCAGTGGTAAAATCGTTTGTGTTTCACA<br>TGAAACAATTAAAAAAGTGAAAGACATATTTACAGACAGTTTCAGTAAA<br>GTAATTAAGGAAAACAACGAGAATAAATCAAAAATTTGCCAAACGAAAA<br>TTATGGCAGGTTGTTACGAGGCATTGGATGATTCAGAGGATATTCTTCAT<br>AACTCTCTAGATAATGATGAATGTAGCACGCATTCACATAAGGTTTTTGC<br>TGACATTCAGAGTGAAGAAATTTTACAACATAACCAAAATATGTCTGGAT<br>TGGAGAAAGTTTCTAAAATATCACCTTGTGATGTTAGTTTGGAAACTTCA<br>GATATATGTAAATGTAGTATAGGGAAGCTTCATAAGTCAGTCTCATCTGC<br>AAATACTTGTGGGATTTTTAGCACAGCAAGTGGAAAATCTGTCCAGGTAT<br>CAGATGCTTCATTACAAAACGCAAGACAAGTGTTTTCTGAAATAGAAGAT<br>AGTACCAAGCAAGTCTTTTCCAAAGTATTGTTTAAAAGTAACGAACATTC<br>AGACCAGCTCACAAGAGAAGAAAATACTGCTATACGTACTCCAGAACAT<br>TTAATATCCCAAAAAGGCTTTTCATATAATGTGGTAAATTCATCTGCTTTC<br>TCTGGATTTAGTACAGCAAGTGGAAAGCAAGTTTCCATTTTAGAAAGTTC<br>CTTACACAAAGTTAAGGGAGTGTTAGAGGAATTTGATTTAATCAGAACTG<br>AGCATAGTCTTCACTATTCACCTACGTCTAGACAAAATGTATCAAAAATA<br>CTTCCTCGTGTTGATAAGAGAAACCCAGAGCACTGTGTAAACTCAGAAAT<br>GGAAAAAACCTGCAGTAAAGAATTTAAATTATCAAATAACTTAAATGTTG<br>AAGGTTGGTTCTTCAGAAAATAATCACTCTATTAAAGTTTCTCCATATCTCT<br>CTCAATTTCAACAAGACAAACAACAGTTGGTATTAGGAACCAAAGTGTCA<br>CTTGTTGAGAACATTCATGTTTTGGGAAAAGAACAGGCTTCACCTAAAAA<br>CGTAAAAATGGAAATTGGTAAAACTGAAACTTTTTCTGATGTTCCTGTGA<br>AAACAAATATAGAAGTTTGTTCTACTTACTCCAAAGATTCAGAAAACTAC<br>TTTGAAACAGAAGCAGTAGAAATTGCTAAAGCTTTTATGGAAGATGATGA<br>ACTGACAGATTCTAAACTGCCAAGTCATGCCACACATTCTCTTTTTACATG<br>TCCCGAAAATGAGGAAATGGTTTTGTCAAATTCAAGAATTGGAAAAAGA<br>AGAGGAGAGCCCCTTATCTTAGTGGGAGAACCCTCAATCAAAAGAAACT<br>TATTAAATGAATTTGACAGGATAATAGAAAATCAAGAAAAATCCTTAAA<br>GGCTTCAAAAAGCACTCCAGATGGCACAATAAAAGATCGAAGATTGTTT<br>ATGCATCATGTTTCTTTAGAGCCGATTACCTGTGTACCCTTTCGCACAACT<br>AAGGAACGTCAAGAGATACAGAATCCAAATTTTACCGCACCTGGTCAAG<br>AATTTCTGTCTAAATCTCATTTGTATGAACATCTGACTTTGGAAAAATCTT<br>CAAGCAATTTAGCAGTTTCAGGACATCCATTTTATCAAGTTTCTGCTACAA<br>GAAATGAAAAATGAGACACTTGATTACTACAGGCAGACCAACCAAAGT<br>CTTTGTTCCACCTTTTAAAACTAAATCACATTTTCACAGAGTTGAACAGTG<br>TGTTAGGAATATTAACTTGGAGGAAAACAGACAAAAGCAAACATTGAT<br>GGACATGGCTCTGATGATAGTAAAAATAAGATTAATGACAATGAGATTC<br>ATCAGTTTAACAAAAACAACTCCAATCAAGCAGTAGCTGTAACTTTCACA<br>AAGTGTGAAGAAGAACCTTTAGATTTAATTACAAGTCTTCAGAATGCCAG<br>AGATATACAGGATATGCGAATTAAGAAGAAACAAAGGCAACGCGTCTTT<br>CCACAGCCAGGCAGTCTGTATCTTGCAAAAACATCCACTCTGCCTCGAAT<br>CTCTCTGAAAGCAGCAGTAGGAGGCCAAGTTCCCTCTGCGTGTTCTCATA<br>AACAGCTGTATACGTATGGCGTTTCTAAACATTGCATAAAAATTAACAGC<br>AAAAATGCAGAGTCTTTTCAGTTTCACACTGAAGATTATTTGGTAAGGA<br>AAGTTTATGGACTGGAAAAGGAATACAGTTGGCTGATGGTGGATGGCTC | |

TABLE B-continued

| Gene Fusion | Chimera Sequence | SEQ ID NO. |
|---|---|---|
| | ATACCCTCCAATGATGGAAAGGCTGGAAAAGAAGAATTTTATAGGGCTCT<br>GTGTGACACTCCAGGTGTGGATCCAAAGCTTATTTCTAGAATTTGGGTTT<br>ATAATCACTATAGATGGATCATATGGAAACTGGCAGCTATGGAATGTGCC<br>TTTCCTAAGGAATTTGCTAATAGATGCCTAAGCCCAGAAAGGGTGCTTCT<br>TCAACTAAAATACAGATATGATACGGAAATTGATAGAAGCAGAAGATCG<br>GCTATAAAAAGATAATGGAAAGGGATGACACAGCTGCAAAAACACTTG<br>TTCTCTGTGTTTCTGACATAATTTCATTGAGCGCAAATATATCTGAAACTT<br>CTAGCAATAAAACTAGTAGTGCAGATACCCAAAAAGTGGCCATTATTGA<br>ACTTACAGATGGGTGGTATGCTGTTAAGGCCCAGTTAGATCCTCCCCTCTT<br>AGCTGTCTTAAAGAATGGCAGACTGACAGTTGGTCAGAAGATTATTCTTC<br>ATGGAGCAGAACTGGTGGGCTCTCCTGATGCCTGTACACCTCTTGAAGCC<br>CCAGAATCTCTTATGTTAAAGATTTCTGCTAACAGTACTCGGCCTGCTCGC<br>TGGTATACCAAACTTGGATTCTTTCCTGACCCTAGACCTTTTCCTCTGCCC<br>TTATCATCGCTTTTCAGTGATGGAGGAAATGTTGGTTGTGTTGATGTAATT<br>ATTCAAAGAGCATACCCTATACAGTGGATGGAGAAGACATCATCTGGATT<br>ATACATATTTCGCAATGAAAGAGAGGAAGAAAAGGAAGCAGCAAAATAT<br>GTGGAGGCCCAACAAAAGAGACTAGAAGCCTTATTCACTAAAATTCAGG<br>AGGAATTTGAAGAACATGAAGAAAACACAACAAAACCATATTTACCATC<br>ACGTGCACTAACAAGACAGCAAGTTCGTGCTTTGCAAGATGGTGCAGAG<br>CTTTATGAAGCAGTGAAGAATGCAGCAGACCCAGCTTACCTTGAGGGTTA<br>TTTCAGTGAAGAGCAGTTAAGAGCCTTGAATAATCACAGGCAAATGTTGA<br>ATGATAAGAAACAAGCTCAGATCCAGTTGGAAATTAGGAAGGCCATGGA<br>ATCTGCTGAACAAAAGGAACAAGGTTTATCAAGGGATGTCACAACCGTG<br>TGGAAGTTGCGTATTGTAAGCTATTCAAAAAAAGAAAAAGATTCAGTTAT<br>ACTGAGTATTTGGCGTCCATCATCAGATTTATATTCTCTGTTAACAGAAGG<br>AAAGAGATACAGAATTTATCATCTTGCAACTTCAAAATCTAAAAGTAAAT<br>CTGAAAGAGCTAACATACAGTTAGCAGCGACAAAAAAAAACTCAGTATCA<br>ACAACTACCGGTTTCAGATGAAATTTTATTTCAGATTTACCAGCCACGGG<br>AGCCCCTTCACTTCAGCAAATTTTTAGATCCAGACTTTCAGCCATCTTGTT<br>CTGAGGTGGACCTAATAGGATTTGTCGTTTCTGTTGTGAAAAAAACAGGA<br>CTTGCCCCTTTCGTCTATTTGTCAGACGAATGTTACAATTTACTGGCAATA<br>AAGTTTTGGATAGACCTTAATGAGGACATTATTAAGCCTCATATGTTAAT<br>TGCTGCAAGCAACCTCCAGTGGCGACCAGAATCCAAATCAGGCCTTCTTA<br>CTTTATTTGCTGGAGATTTTTCTGTGTTTTCTGCTAGTCCAAAAGAGGGCC<br>ACTTTCAAGAGACATTCAACAAAATGAAAAATACTGTTGAGAATATTGAC<br>ATACTTTGCAATGAAGCAGAAAACAAGCTTATGCATATACTGCATGCAAA<br>TGATCCCAAGTGGTCCACCCCAACTAAAGACTGTACTTCAGGGCCGTACA<br>CTGCTCAAATCATTCCTGGTACAGGAAACAAGCTTCTGATGTCTTCTCCTA<br>ATTGTGAGATATATTATCAAAGTCCTTTATCACTTTGTATGGCCAAAAGG<br>AAGTCTGTTTCCACACCTGTCTCAGCCCAGATGACTTCAAAGTCTTGTAA<br>AGGGGAGAAAGAGATTGATGACCAAAAGAACTGCAAAAAGAGAAGAGC<br>CTTGGATTTCTTGAGTAGACTGCCTTTACCTCCACCTGTTAGTCCCATTTG<br>TACATTTGTTTCTCCGGCTGCACAGAAGGCATTTCAGCCACCAAGGAGTT<br>GTGGCACCAAATACGAAACACCCATAAAGAAAAAAGAACTGAATTCTCC<br>TCAGATGACTCCATTTAAAAAATTCAATGAAATTTCTCTTTTGGAAAGTA<br>ATTCAATAGCTGACGAAGAACTTGCATTGATAAATACCCAAGCTCTTTTG<br>TCTGGTTCAACAGGAGAAAAACAATTTATATCTGTCAGTGAATCCACTAG<br>GACTGCTCCCACCAGTTCAGAAGATTATCTCAGACTGAAACGACGTTGTA<br>CTACATCTCTGATCAAAGAACAGGAGAGTTCCCAGGCCAGTACGGAAGA<br>ATGTGAGAAAAATAAGCAGGACACAATTACAACTAAAAAATATATCTAA | |
| CLEC16A<br>-><br>BCAR4 | ATGTTTGGCCGCTCGCGGAGCTGGGTGGGCGGGGCCATGGCAAGACTTC<br>CCGCAACATCCACTCCTTGGACCACCTCAAGTATCTGTACCACGTTTTGAC<br>CAAAAACACCACAGTCACAGAACAGAACCGGAACCTGCTAGTGGAGACC<br>ATCCGTTCCATCACTGAGATCCTGATCTGGGGAGATCAAAATGACAGCTC<br>TGTATTTGACTTCTTCCTGGAGAAGAATATGTTTGTTTTCTTCTTGAACAT<br>CTTGCGGCAAAAGTCGGGCCGTTACGTGTGCGTTCAGCTGCTGCAGACCT<br>TGAACATCCTCTTTGAGAACATCAGTCACGAGACCTCACTTTATTATTTGC<br>TCTCAAATAACTACGTAAATTCTATCATCGTTCATAAATTTGACTTTTCTG<br>ATGAGGAGATTATGGCCTATTATATCGTTCCTGAAAACACTTTCGTTA<br>AAACTCAACAACCACACTGTCCATTTCTTTTATAATGAGCACACCAATGA<br>CTTTGCCCTGTACACAGAAGCCATCAAGTTTTTCAACCACCCTGAAAGCA<br>TGGTTAGAATTGCTGTAAGAACCATAACTTTGAATGTCTATAAAGTCTCA<br>GTGGATAACCAGGCCATGCTGCACTACATCCGAGATAAAACTGCTGTTCC<br>TTACTTCTCCAATTTGGTCTGGTTCATTGGGAGCCATGTGATCGAACTCGA<br>TGACTGCGTGCAGACTGATGAGGAGCATCGGAATCGGGGTAAACTGAGT<br>GATCTGGTGGCAGAGCACCTAGACCACCTGCACTATCTCAATGACATCCT<br>GATCATCAACTGTGAGTTCCTCAACGATGTGCTCACTGACCACCTGCTCA<br>ACAGGCTCTTCCTGCCCCTCTACGTGTACTCACTGGAGAACCAGGACAAG<br>GGAGGAGAACGGCCGAAAATTAGCCTGCCGGTGTCTCTTTATCTTCTGTC<br>ACAGGTCTTCTTAATTATACATCATGCACCGCTGGTGAACTCGTTAGCTG<br>AAGTCATTCTGAATGGTGATCTGTCTGAGATGTACGCTAAGACTGAACAG<br>GATATTCAGAGAAGTTCTGCCAAGCCCAGCATTCGGTGCTTCATTAAACC<br>CACCGAGACACTCGAGCGGTCCCTTGAGATGAACAAGCACAAGGGCAAG<br>AGGCGGGTGCAAAAGAGACCCAACTACAAAAACGTTGGGGAAGAAGAA<br>GATGAGGAGAAAGGGCCCACCGAGGATGCCCAAGAAGACGCCGAGAAG<br>GCTAAAGGTACAGAGGGTGGTTCAAAAGGCATCAAGACGAGTGGGGAGA | SEQ ID NO: 13 |

TABLE B-continued

| Gene Fusion | Chimera Sequence | SEQ ID NO. |
|---|---|---|
| | GTGAAGAGATCGAGATGGTGATCATGGAGCGTAGCAAGCTCTCAGAGCT GGCCGCCAGCACCTCCGTGCAGGAGCAGAACACCACGGACGAGGAGAAA AGCGCCGCCGCCACCTGCTCTGAGAGCACGCAATGGAGCAGACCCTTCCT GGATATGGTGTACCACGCGCTGGACAGCCCGGATGATGATTACCATGCCC TGTTCGTGCTCTGCCTCCTCTATGCCATGTCTCATAATAAAGGCATGGATC CTGAAAAATTAGAGCGAATCCAGCTCCCCGTGCCAAATGCGGCCGAGAA GACCACCTACAACCACCCGCTAGCTGAAAGACTCATCAGGATCATGAAC AACGCTGCCCAGCCAGATGGGAAGATCCGGCTGGCGACGCTGGAGCTGA GCTGCCTGCTTCTGAAGCAGCAAGTCCTGATGAGTGCTGGCTGCATCATG AAGGACGTGCACCTGGCCTGCCTGGAGGGTGCGAGAGAAGAAAGTGTTC ACCTTGTACGACATTTTTATAAGGGAGAAGACATTTTTTTGGACATGTTTG AAGATGAGTATAGGAGCATGACAATGAAGCCCATGAACGTGGAATATCT CATGATGGACGCCTCCATCCTGCTGCCCCCAACAGGCACGCCACTGACGG GCATTGACTTCGTGAAGCGGCTGCCGTGTGGCGATGTGGAGAAGACCCG GCGGGCCATCCGGGTGTTCTTCATGCTGCGTTCCCTGTCACTGCAATTGCG AGGGGAGCCTGAGACACAGTTGCCGCTGACTCGGGAGGAGGACCTGATC AAGACTGATGATGTCCTGGATCTGACAAAAAATCACCATGTACCAACCTA TCCAAACTTATCCATGGATGAATCTATCCAGAAGACGGGAGTTCCGATGC TTGTCTTGCTCTGAATGTCTGCTTGTCACCTGCTTAGGGTTATCGACTGTG ATTCTGGGACTCATTGTTGTTCTACAGGACCCCTCTGACTCTGTGGTTTTC TCTACTGGATTAACAATGATAGCCATAGGTGCTTTTTTTGTTGTCCTCACT GGAGTGACAGCCCTGTGTACGGTTACAGTCGACGAGAACTTGCAGAAAA CCACGAGGCTAAGACTAGGAGTGATACGAAAAAGCGGAAGTCTCCAAGG AACTACAGAGCCTTCCATGACTCACTCAATAATCGCTAGCACCTCGCTGT AGTTGTACATTGAACCCTGGCATCTTCGTCTTTGGAACTAAGTCTCCTGAG CATTGTTTTTAAATAGAAATAAAATCTGGCTTTTAA | |
| ERBB2-> IKZF3 | ATGGAGCTGGCGGCCTTGTGCCGCTGGGGGCTCCTCCTCGCCCTCTTGCC CCCCGGAGCCGCGAGCACCCAAGTGTGCACCGGCACAGACATGAAGCTG CGGCTCCCTGCCAGTCCCGAGACCCACCTGGACATGCTCCGCCACCTCTA CCAGGGCTGCCAGGTGGTGCAGGGAAACCTGGAACTCACCTACCTGCCC ACCAATGCCAGCCTGTCCTTCCTGCAGGATATCCAGGAGGTGCAGGGCTA CGTGCTCATCGCTCACAACCAAGTGAGGCAGGTCCCACTGCAGAGGCTGC GGATTGTGCGAGGCACCCAGCTCTTTGAGGACAACTATGCCCTGGCCGTG CTAGACAATGGAGACCCGCTGAACAATACCACCCCTGTCACAGGGGCCTC CCCAGGAGGCCTGCGGGAGCTGCAGCTTCGAAGCCTCACAGAGATCTTG AAAGGAGGGGTCTTGATCCAGCGGAACCCCCAGCTCTGCTACCAGGACA CGATTTTGTGGAAGGACATCTTCCACAAGAACAACCAGCTGGCTCTCACA CTGATAGACACCAACCGCTCTCGGGCCTGCCACCCCTGTTCTCCGATGTG TAAGGGCTCCCGCTGCTGGGGAGAGAGTTCTGAGGATTGTCAGAGCCTGA CGCGCACTGTCTGTGCCGGTGGCTGTGCCCGCTGCAAGGGGCCACTGCCC ACTGACTGCTGCCATGAGCAGTGTGCTGCCGGCTGCACGGGCCCCAAGCA CTCTGACTGCCTGGCCTGCCTCCACTTCAACCACAGTGGCATCTGTGAGCT GCACTGCCCAGCCCTGGTCACCTACAACACAGACACGTTTGAGTCCATGC CCAATCCCGAGGGCCGGTATACATTCGGCGCCAGCTGTGTGACTGCCTGT CCCTACAACTACCTTTCTACGGACGTGGGATCCTGCACCCTCGTCTGCCCC CTGCACAACCAAGAGGTGACAGCAGAGGATGGAACACAGCGGTGTGAGA AGTGCAGCAAGCCCTGTGCCCGAGTGTGCTATGGTCTGGGCATGGAGCAC TTGCGAGAGGTGAGGGCAGTTACCAGTGCCAATATCCAGGAGTTTGCTGG CTGCAAGAAGATCTTTGGGAGCCTGGCATTTCTGCCGGAGAGCTTTGATG GATGATTCAATGAAAGTGAAAGATGAATACAGTGAAAGAGATGAGAATG TTTTAAAGTCAGAACCCATGGGAAATGCAGAAGAGCCTGAAATCCCTTAC AGCTATTCAAGAGAATATAATGAATATGAAAACATTAAGTTGGAGAGAC ATGTTGTCTCATTCGATAGTAGCAGGCCAACCAGTGGAAAGATGAACTGC GATGTGTGTGGATTATCCTGCATCAGCTTCAATGTCTTAATGGTTCATAAG CGAAGCCATACTGGTGAACGCCCATTCCAGTGTAATCAGTGTGGGGCATC TTTTACTCAGAAAGGTAACCTCCTCCGCCACATTAAACTGCACAGGGG AAAAACCTTTTAAGTGTCACCTCTGCAACTATGCATGCAAAGAAGAGAT GCGCTCACGGGGCATCTTAGGACACATTCTGTGGAGAAACCCTACAAATG TGAGTTTTGTGGAAGGAGTTACAAGCAGAGAAGTTCCCTTGAGGAGCAC AAGGAGCGCTGCCGTACATTTCTTCAGAGCACTGACCCAGGGGACACTGC AAGTGCGGAGGCAAGACACATCAAAGCAGAGATGGGAAGTGAAAGAGC TCTCGTACTGGACAGATTAGCAAGCAATGTGGCAAAACGAAAAAGCTCA ATGCCTCAGAAATTCATTGGTGAGAGCGCCACTGCTTTGATGTCAACTA TAATTCAAGTTACATGTATGAGAAAGAGAGTGAGCTCATACAGACCCGC ATGATGGACCAAGCCATCAATAACGCCATCAGCTATCTTGGCGCCGAAGC CCTGCGCCCCTTGGTCCAGACACCGCCTGCTCCCACCTCGGAGATGGTTC CAGTTATCAGCAGCATGTATCCCATAGCCCTCACCCGGGCTGAGATGTCA AACGGTGCCCCTCAAGAGCTGGAAAAGAAAAGCATCCACCTTCAGAGA AGAGCGTGCCTTCTGAGAGAGGCCTCTCTCCCAACAATAGTGGCCACGAC TCCACGGACACTGACAGCAACCATGAAGAACGCCAGAATCACATCTATC AGCAAAATCACATGGTCCTGTCTCGGGCCCGCAATGGGATGCCACTTCTG AAGGAGGTTCCCCGCTCTTACGAACTCCTCAAGCCCCCGCCCATCTGCCC | SEQ ID NO: 14 |

TABLE B-continued

| Gene Fusion | Chimera Sequence | SEQ ID NO. |
|---|---|---|
| | AAGAGACTCCGTCAAAGTGATCAACAAGGAAGGGGAGGTGATGGATGTG<br>TATCGGTGTGACCACTGCCGCGTCCTCTTCCTGGACTATGTGATGTTCACG<br>ATTCACATGGGCTGCCACGGCTTCCGTGACCCTTTCGAGTGTAACATGTG<br>TGGATATCGAAGCCATGATCGGTATGAGTTCTCGTCTCACATAGCCAGAG<br>GAGAACACAGAGCCCTGCTGAAGTGA | |
| TANC2-><br>RDM1 | ATGTTTCGGAATAGTCTCAAGATGCTGCTTACTGGTGGGAAATCAAGTCG<br>TAAAAACAGGTCAAGTGAAAGTGGTAAAATAGCTGTGGAGTACAGACCC<br>AGTGAAGACATCGTAGGTGTCAGATGCGAAGAAGAACTACACGGTTTAA<br>TTCAAGTCCCTTGCTCTCCCTGGAAGCAGTATGGCCAAGAGGAGGAAGGG<br>TATCTCTCGGATTTCAGCTTGGAGGAGGAAGAGTTCAGGCTGCCAGAACT<br>TGACTAG | SEQ ID NO: 15 |
| PIK3C3-><br>RPRD1A | ATGGGGGAAGCAGAGAAGTTTCACTACATCTATAGTTGTGACCTGGATAT<br>CAACGTCCAGCTTAAGATAGGAAGCTTGGAAGGGAAGAGAGAACAAAAG<br>AGTTATAAAGCTGTCCTGGAAGACCCAATGTTGAAGTTCTCAGGACTATA<br>TCAAGAGACATGCTCTGATCTTTATGTTACTTGTCAAGTTTTTGCAGAAGG<br>GAAGCCTTTGGCCTTGCCAGTGAGAACATCCTACAAAGCATTTAGTACAA<br>GATGGAACTGGAATGAATGGCTGAAACTACCAGTAAAATACCCTGACCT<br>GCCCAGGAATGCCCAAGTGGCCCTCACCATATGGGATGTGTATGGTCCCG<br>GAAAAGCAGTGCCTGTAGGAGGAACAACGGTTTCGCTCTTTGGAAAATA<br>CGGCATGTTTCGCCAAGGGATGCATGACTTGAAAGTCTGGCCTAATGTAG<br>AAGCAGATGGATCAGAACCCACAAAAACTCCTGGCAGAACAAGTAGCAC<br>TCTCTCAGAAGATCAGATGAGCCGTCTTGCCAAGCTCACCAAAGCTCATC<br>GACAAGGACACATGGTGAAAGTAGATTGGCTGGATAGATTGACATTTAG<br>AGAAATAGAAATGATAAATGAGAGTGAAAAACGAAGTTCTAATTTCATG<br>TACCTGATGGTTGAATTTCGATGTGTCAAGTGTGATGATAAGGAATATGG<br>TATTGTTTATTATGAAAAGGACGGTGATGAATCATCTCCAATTTTAACAA<br>GTTTTGAATTAGTGAAAGTTCCTGACCCCCAGATGTCTATGGAATTTA<br>GTTGAGAGCAAACACCACAAGCTTGCCCGGAGTTTAAGAAGTGGACCTTC<br>TGACCACGATCTGAAACCCAATGCTGCCACGAGAGATCAGTTAAATATTA<br>TTGTGAGTTATCCACCAACCAAGCAACTTACATATGAAGAACAAGATCTT<br>GTTTGGAAGTTTAGATATTATCTTACGAATCAAGAAAAAGCCTTGACAAA<br>ATTCTTGAAATGTGTTAATTGGGATCTACCTCAAGAGGCCAAACAGGCCT<br>TGGAACTTCTGGGAAAATGGAAGCCGATGGATGTAGAGGACTCCTTGGA<br>GCTGTTATCCTCTCATTACACCAACCCAACTGTGAGGCGTTATGCTGTTGC<br>CCGGTTGCGACAGGCCGATGATGAGGATTTGTTGATGTACCTATTACAAT<br>TGGTCCAGGCTCTCAAATATGAAAATTTTGATGATATAAAGAATGGATTG<br>GAACCTACCAAGAAGGATAGTCAGAGTTCAGTGTCAGAAAATGTGTCAA<br>ATTCTGGAATAAATTCTGCAGAAATAGATAGCTCCCAAATTATAACCAGC<br>CCCCTTCCTTCAGTCTCTTCACCTCCTCCTGCATCAAAAACAAAAGAAGTT<br>CCAGATGGCGAAAATCTGGAACAAGATCTCTGTACCTTCTTGATATCGAG<br>AGCCTGCAAAAACTCAACACTGGCTAATTATTTATACTGGTATGTGATAG<br>TGGAATGTGAAGATCAAGATACTCAGCAGAGAGATCCAAAGACCCATGA<br>GATGTACTTGAACGTAATGAGAAGATTCAGCCAAGCATTGTTGAAGGGTG<br>ATAAGTCTGTCAGAGTTATGCGTTCTTTGCTGGCTGCACAACAGACATTT<br>GTAGATCGGTTGGTGCATCTAATGAAGGCAGTACAACGCGAAAGTGGAA<br>ATCGTAAGAAAAAGAATGAGAGACTACAGGCATTGCTTGGAGATAATGA<br>AAAGATGAATTTGTCAGATGTGGAACTTATCCCGTTGCCTTTAGAACCCC<br>AAGTGAAAATTAGAGGAATAATTCCGGAAACAGCTACACTGTTTAAAAG<br>TGCCCTTATGCCTGCACAGTTGTTTTTTAAGACGGAAGATGGAGGCAAAT<br>ATCCAGTTATATTTAAGCATGGAGATGATTTACGTCAAGATCAACTTATT<br>CTTCAAATCATTTCACTCATGGACAAGCTGTTACGGAAAGAAAATCTGGA<br>CTTGAAATTGACACCTTATAAGGTGTTAGCCACCAGTACAAAACATGGCT<br>TCATGCAGTTTATCCAGTCAGTTCCTGTGGCTGAAGTTCTTGATACAGAG<br>GGAAGCATTCAGAACTTTTTTAGAAAATATGCACCAAGTGAGAATGGGCC<br>AAATGGGATTAGTGCTGAGGTCATGGACACTTACGTTAAAAGCTGTGCTG<br>GATATTGCGTGATCACCTATATACTTGGAGTTGGAGACAGGCACCTGGAT<br>AACCTTTTGCTAACAAAAACAGCCAAACCAAACAGGAAGCTTACTTTTCT<br>CTACCTAGCCAATGATGTCATACAGAACAGCAAGAGGAAGGGGCCAGAG<br>TTTACAAAAGATTTTGCACCAGTTATAGTGGAGGCTTTTAAGCATGTTTCA<br>AGTGAAACTGATGAAAGTTGTAAGAAGCACCTTGGAAGAGTGTTATCTAT<br>TTGGGAAGAAAGGTCTGTTTATGAAAATGATGTATTAGAACAACTTAAAC<br>AAGCTCTGTATGGTGATAAGAAGCCTAGGAAGCGAACTTATGAACAGAT<br>AAAGGTGGATGAAAATGAAAACTGTTCCTCTCTGGGATCTCCAAGTGAAC<br>CACCACAGACTCTAGATCTCGTTAGAGCATTACAAGATCTGGAAAATGCA<br>GCCTCAGGTGATGCAGCAGTTCATCAGAGGATAGCTTCTTTACCTGTTGA<br>AGTCCAAGAAGTATCTCTATTAGATAAAATAACAGATAAAGAATCTGGA<br>GAAAGGCTTTCCAAAATGGTAGAGGATGCGTGTATGTTGCTGGCAGATTA<br>CAATGGCAGATTGGCGGCAGAAATAGATGATAGAAAGCAACTCACTCGA<br>ATGTTAGCAGATTTTCTTCGTTGTCAAAAGGAAGCCCTTGCAGAGAAAGA<br>GCATAAATTGGAAGAGTACAAGCGCAAGCTAGCCAGAGTTTCCCTGGTG<br>CGCAAAGAACTCAGGTCCCGGATCCAGAGCCTGCCAGCTTATCTCGATT<br>GCCCAATGTCACTGGCAGCCACATGCACCTGCCCTTTGCGGGAGACATCT<br>ACAGTGAAGATTGA | SEQ ID NO: 16 |

TABLE B-continued

| Gene Fusion | Chimera Sequence | SEQ ID NO. |
|---|---|---|
| PPP2R1A -> NLRP8 | ATGGCGGCGGCCGACGGCGACGACTCGCTGTACCCCATCGCGGTGCTCAT AGACGAACTCCGCAATGAGGACGTTCAGCTTCGCCTCAACAGCATCAAG AAGCTGTCCACCATCGCCTTGGCCCTTGGGGTTGAAAGGACCCGAAGTGA GCTTCTGCCTTTCCTTACAGATACCATCTATGATGAAGATGAGGTCCTCCT GGCCCTGGCAGAACAGCTGGGAACCTTCACTACCCTGGTGGGAGGCCCA GAGTACGTGCACTGCCTGCTGAGCGCCAGAGAGCAATGGGCTGCATCGTT GGTGGCAAGACTTATGCTCTGTGTTTGCAACGAATGATAAGCTGGAAGTC CTGACTATGACCAACAGTGTTTTGGGGCCTCCTTTTTTGAAGGCTCTCGCG GCCGCACTGAGGCACCCTCAGTGCAAACTGCAAAAGCTACTCCTAAGGC GTGTGAATAGCACCATGTTGAACCAGGACTTAATCGGTGTTTTGACGGGG AACCAGCATCTGAGATACTTGGAAATACAACATGTGGAAGTGGAGTCCA AAGCTGTGAAGCTTCTATGCAGGGTGCTGAGATCCCCCCGGTGCCGTCTG CAGTGTCTCAGGTTGGAAGACTGCTTGGCCACCCCTAGAATTTGGACTGA TCTTGGCAATAATCTTCAAGGTAACGGGCATCTAAAGACTCTCATACTAA GAAAAAACTCCCTGGAGAACTGTGGGCGTATTACCTGTCTGTGGCCCAG CTGGAGAGGCTGTCGATAGAGAACTGCAACCTTACACAGCTTACTTGTGA AAGCCTTGCCTCCTGTCTCAGGCAGAGTAAGATGCTGACCCACCTGAGCT TGGCAGAAAACGCCTTGAAAGATGAAGGGGCCAAGCATATTTGGAATGC CCTGCCACACCTGAGATGTCCTCTGCAGAGGCTGGTACTGAGAAAGTGTG ACTTGACCTTTAATTGCTGTCAGGATATGATCTCTGCGCTCTGTAAAAATA AAACCCTGAAAAGTCTTGACCTAAGTTTTAATAGCCTGAAGGATGATGGG GTGATCCTGCTGTGTGAGGCCCTGAAGAACCCTGACTGTACATTACAGAT CCTGGAGCTGGAAAACTGCCTGTTCACCTCCATCTGCTGCCAGGCCATGG CTTCCATGCTCCGCAAAAACCAACATCTGAGACATCTGGACTTGAGCAAG AATGCGATTGGAGCTCTATGGTATTCTGACCTTGTGCGAGGCCTTCTCAAG CCAAAAGAAGAGAAGAGGTCATTTTCTGTATTCCTGCCTGGACTCGAA TAACTAGCTTCTCCCCAACTCCTCACCCACCCGACTTCACGGGAAAAAGT GACTGCCTATCCCAGATTAATCCTTAG | SEQ ID NO: 17 |
| RPS28-> LOC100505619 | ATGGACACCAGCCGTGTGCAGCCTATCAAGCTGGCCAGGGTCACCAAGG TCCTGGGCAGGACCGGTTCTCAGGGACAGTGCACGCAGGGTTCTTCTGCT CACTGGGTCAGAAGCATCCGATTTCCTGTCATCGGTTGCGGTTCAGCCAT GTTAATACTGAAAGTATAAGAATATCATAATCCCAGAGTGATATAAAGAC CTTTTCCAAGGAAGATGAGATACCCGGAGGCTGTGAAGGAGAAGTCTGAA GGATTTGAACGCGTTCAAATGAAAACCTTTGGTTCAGCAAAACACCAGAA ACAAATTCAAAAGATAAAATACACTCCGGAGAAGCCCATTCTCTCAACGC ATCTGACAGTTCACAAAGAGCAACTGCAGTCCAACTTAAAAAATAAAGA AAATGGTAGGAAAATGGGCAACATGCACTGAGGCAATATATAAGAAGAA GGAATGCGCAATTAATCAACAAAAGCCTGCTCTTTCCTAACGAGTGAAGA TACAAGCTTAGTAAATATTAAAATTTATTGAAGATAAAAATGGACACTTC CGGCCCATATATAAAAGCATTGTTGGTAAGAGAGTGGGGTAATTGACATGC TCCTGGGAAATAATACGCATTCAGACAACCTCTAATGAGTGAATCCACTG GGGGTATCCACTAGGAATAGAAAACGACCACCAATGCCCAAGTTTGTGG TCCAGAATTTGAGCAGCGATCTAACAAAGTAGAGTCTCCCCCTGTGTCAT GGGCCCCACTTCTTAAGCAAAGAAGAATGCCTCATTTTGGTAACTCACCC AAATAAACAGAAATTTTTTTGATAATCTTATCGCATTTATTTGGTTAAGT CTGAGGCAGAATATTTTCTCCTTTGTATCTTTGTTTTGTTTTGTTTTAATC CTTGAAGTTTATTACCAAACTACATCTTGGTGTTTCTTCAGGATGTGAACA GGCCTTTCTATTCTCAATTAAGTGTTTCTTTCCTTTAATTCAGGAATCTTCT AATCATGTATTTTAATTTCTTTTTCTGTCATCCCTCCCCACGCCATAAGCT ACCAGTCACTATACATGTTGGAGCTCTCTTTATTGTGCCATAGATCTCTGA TGTCATGTCTTTAGTCATTATTTTGTGTCAGAAATTTTTGTTCTTCCGGGG ACATCTGGCAATATCTAGAGACATGCTACTGGCACCTATAGAAATGCTAG TGACTTATTATGGGTAGAGGCTAAAGATGCTGCTAAATATCCTACAATGC CCAGGACAGCCACTGCCACAACAAAGAATTATGCAGTCCACAATGTCCAT AGTGCTAAGGAGAAGAAACCCTGTCCTAGGGTCAAGGTTGGATGCTGAC AAGACTAATTTCAAGTGATTTCAAACGATTGTGGGGAAAATACCCAGAA GTTGACAGGAGCAATATGTAGATATTTCCTTCTGTAAATTATATTTCCCTA ATGCTAATGCTGGAGCATTTGGAAACACGTGTATAAATATTTGAAGCACA AAACCAGAGATGCTCTTATGTATTTAGCTTCTAGTTTTAAATAATAGA TACTACAATAAACCTTGATTAAACCTTGATTATCTG | SEQ ID NO: 18 |
| NFYA-> TDRG1 | GAACGGTCACTGCGCAGGATCAAGCTACAATGAAGAGGAGGAGGCAGT CTGCGCGCACCGCCATTTTCTAGGAACTGGGAAGCCCCCCACCCCTTAG GAAGATCCATCCCTGTGGAACCTTGCCCAGGCTTACCAGCCTTTGCTGAG GTTGATCTATTGTCCCTCCTTGTCCCCATCAAAATATCCAGCACTCCACCT TCAGGGAGTAGACTTGACCCTCAAATAGCAAGTTCAGCCTTCCCAGGTCT AGGTTCCCTGGGAGGTCAAGATTCGTCTGGTTCCTTAGTACAGAGGGCTA GCTGTGAGTTGGAATCCCCTATGAGCTTTAGAATCAGTCAAGAGGAATT GGGCCCCTTCCCTTCATCCCTCTTCTTTTCCTTTTTGTCCCAGAGCTCAGC TCTGACTCAAAAGTTTTTCCATTTACCATCAACATGGAAACTTTGGCTCCTC ACGTAGGTATATTATCCCCCTTTTGTACATGGTCTTGTTGATCCAAACTCC CTTTCTGTGAAGAGGCCTGTGGGGCTCAAGAAGCCTGGTCAGCCAGCCA GGCTAGTCCCACATACCTCAGAACCAGTTTAATAAAGGCTCTATGTCATT CTTTTTTG | SEQ ID NO: 19 |

TABLE B-continued

| Gene Fusion | Chimera Sequence | SEQ ID NO. |
|---|---|---|
| RIMS2->DPYS | ATGTCGGCTCCTGTCGGGCCCCGGGGCCGCCTGGCTCCCATCCCGGCGGC CTCTCAGCCGCCTCTGCAGCCCGAGATGCCTGACCTCAGCCACCTCACGG AGGAGGAGAGGAAAATCATCCTGGCCGTCATGGATAGGCAGAAGAAAGA AGAGGAGAAGGAGCAGTCCGTGCTCAAAAAACTGCATCAGCAGTTTGAA ATGTATAAAGAGCAGGTAAAGAAGATGGGAGAAGAATCACAGCAACAG CAAGAACAGAAGGGTGATGCGCCAACCTGTGGTATCTGCCACAAAACAA AGTTTGCTGATGGATGTGGCCATAACTGTTCATATTGCCAAACAAAGTTC TGTGCTCGTTGTGGAGGTCGAGTGTCATTACGCTCAAACAAGCATAGTGG TAAAATGGATGAAAACAGATTTGTGGCAGTTACCAGCACAAATGCAGCC AAAATTTTAATCTCTATCCAAGAAAAGGAAGAATAGCTGTAGGATCAGA TGCTGACATTGTTATTTGGGACCCAAAAGGCACAAGGACTATCTCAGCAA AAACTCATCATCAGGCTGTTAACTTCAACATTTTCGAGGGCATGGTTTGC CACGGGGTGCCCCTTGTGACTATTTCAAGAGGCAAAGTGGTATATGAAGC CGGAGTGTTCAGTGTCACGGCAGGAGATGGGAAGTTTATTCCTCGAAAAC CATTTGCTGAATATATTTACAAACGAATAAAGCAGCGAGACCGGACTTGC ACACCTACCCCTGTGGAGCGTGCACCCTATAAGGGAGAAGTCGCCACACT GAAATCCAGAGTGACAAAAGAAGATGCCACAGCAGGGACCAGGAAACA GGCCCACCCCTGA | SEQ ID NO: 20 |
| B3GALNT2 ->TOMM20 | ATGCGAAACTGGCTGGTGCTGCTGTGCCCGTGTGTGCTCGGGGCCGCGCT GCACCTCTGGCTGCGGCTGCGCTCCCGCCGCCCGCCTGCGCCTCCGGGG CCGGCCCTGCAGATCAGTTGGCCTTATTTCCTCAGTGGAAATCTACTCACT ATGATGTGGTAGTTGGCGTGTTGTCAGCTCGCAATAACCATGAACTTCGA AACGTGATAAGAAGCACCTGGATGAGACATTTGCTACAGCATCCCACATT AAGTCAACGTGTGCTTGTGAAGTTCATAATAGGTGCTCATGGCTGTGAAG TGCCTGTGGAAGACAGGGAAGATCCTTATTCCTGTAAACTACTCAACATC ACAAATCCAGTTTTGAATCAGGAAATTGAAGCGTTCAGTCTGTCCGAAGA CACTTCATCGGGGCTGCCTGAGGATCGAGTTGTCAGCGTGAGTTTCCGAG TTCTCTACCCCATCGTTATTACCAGTCTTGGAGTGTTCTACGATGCCAATG ATGTGGGTTTCCAGAGGAACATCACTGTCAAACTTTATCAGGCAGAACAA GAGGAGGCCCTCTTCATTGCTCGCTTCAGTCCTCCAAGCTGTGGTGTGCA GGTGAACAAGCTGTGGTACAAGCCCGTGAACAATTCATCTTACCAGAG AGCTTTGAAGGTACAATCGTGTGGGAGAGCCAAGACCTCCACGGCCTTGT GTCAAGAAATCTCCACAAAGTGACAGTGAATGATGGAGGGGGAGTTCTC AGAGTCATTACAGCTGGGGAGGGTGCATTGCCTCATGAATTCTTGGAAGG TGTGGAGGGAGTTGCAGGTGGTTTTATATATACTATTCAGGGTGAATATG AGAAGGGCGTAGACCATCGACAAATGCAATTGCTGTGTGGACAGCC ACAGCAGTTACTGCAGGTCTTACAGCAAACTCTTCCACCACCAGTGTTCC AGATGCTTCTGACTAAGCTCCCAACAATTAGTCAGAGAATTGTAAGTGCT CAGAGCTTGGCTGAAGATGATGTGGAATGA | SEQ ID NO: 21 |
| C1orf109->MACF1 | ATGACTCAAGACCGGCCTCTGCTTGCCGTGCAGGAGGCGCTGAAGAAGT GCTTCCCCGTGGTGGAGGAGCAGCAGGGCCTGTGGCAGAGTGCCTGGG GGACTGCCAGCCCCTCCTGTCCTCCCTCAGCAACCTGGCGGAACAGCTGC AGGCCGCACAGAACCTGCGGTTTGAGGATGTGCCGGCCGCTTCGGGCCTTC CCAGATTTAAAAGAGCGGCTGAGGCGTAAGCAGCTGGTGGCTGGTGACA TCGTCCTGGACAAGCTAGGGGAAAGGCTGCTCTCAGAAAAAGAGAAGAA ACAAATATCTGAGCAATTGAATGCCCTAAACAAGGCTTACCATGACCTTT GTGATGGTTCTGCAAATCAGCTTCAGCAGCTTCAGAGCCAGTTGGCTCAC CAGACAGAACAAAAGACCCTGCAGAAACAACAAAATACCTGTCACCAGC AACTGGAGGATCTTTGCAGTTGGGTAGGACAGGCAGAAAGAGCACTGGC AGGCCACCAAGGCAGAACCACCCAGCAGGATCTCTCTGCTTTGCAGAAG AACCAAAGTGACTTGAAGGATTTACAGGATGACATTCAGAATCGTGCCAC CTCATTTGCCACTGTTGTCAAGGACATTGAGGGGTTCATGGAAGAGAATC AGACCAAGCTGAGCCCACGTGAGTTGACAGCTCTTCGGGAAAAGCTTCAT CAGGCTAAGGAGCAATATGAGGCGCTCCAGGAAGAGACACGTGTGGCCC AGAAGGAACTGGAGGAAGCAGTGACCTCCGCCTTACAGCAGGAGACTGA AAAGAGTAAAGCAGCAAAGGAACTGGCAGAGAACAAGAAGAAGATCGA TGCTCTCCTGGATTGGGTAACTTCAGTAGGATCATCTGGTGGACAGCTGC TGACCAACCTTCCAGGAATGAGCAGCTCTCGGGAGCTAGCTTGGAGAA AGGAGCCTTGGACACCACTGATGGTTACATGGGGGTGAATCAAGCCCCA GAGAAACTGGACAAGCAATGTGAGATGATGAAGGCCCGTCACCAAGAAT TGCTGTCCCAGCAGCAAAATTTCATTCTGGCCACCCAGTCAGCTCAGGCC TTCTTGGATCAGCATGGCCACAATCTCACACCTGAGGAGCAACAGATGCT GCAACAGAAGCTGGGAGAGCTAAAGGAACAATACTCTACTTCCCTGGCC CAATCAGAGGCAGAACTGAAGCAGGTGCAGACACTTCAGGATGAGTTGC AGAAATTTCTGCAGGATCATAAAGAGTTTGAAAGCTGGTTGGAACGATCC GAGAAAGAGCTGGAGAACATGCATAAGGGAGGCAGCAGCCCCGAGACC CTTCCCTCCCTGCTAAAGCGGCAAGGAAGCTTCTCAGAGGATGTCATTTC CCACAAGGGAGACTTGAGATTTGTGACTATCTCAGGACAGAAAGTCTTGG ACATGGAAAACAGTTTTAAGGAAGGCAAAGAACCATCAGAAATTGGAAA CTTAGTAAAGGACAAGTTGAAGGATGCAACAGAAAGATACACTGCTCTC CACTCAAAGTGTACACGATTAGGATCTCACCTGAATATGCTGTTAGGCCA GTATATCAATTCCAAAACAGTGCTGACAGCCTGCAGGCCTGGATGCAGG CTTGTGAGGCCAACGTGGAGAAGCTCCTCTCAGATACTGTTGCCTCTGAC CCTGGAGTTCTCCAGGAGCAGCTTGCAACAACAAAGCAGTTGCAGGAGG AATTGGCTGAGCACCAAGTACCTGTGGAAAAACTCCAAAAAGTAGCTCG | SEQ ID NO: 22 |

TABLE B-continued

| Gene Fusion | Chimera Sequence | SEQ ID NO. |
|---|---|---|
| | TGACATAATGGAAATTGAAGGGGAGCCAGCCCCAGACCACAGGCATGTT<br>CAAGAAACTACAGATTCCATACTCAGCCACTTCCAAAGCCTCTCCTATAG<br>CCTGGCTGAGCGATCTTCTCTGCTGCAGAAAGCAATTGCCCAATCTCAGA<br>GTGTCCAGGAAAGCCTGGAGAGCCTGTTGCAGTCTATTGGGGAAGTTGAA<br>CAAAACCTGGAAGGGAAGCAGGTGTCATCACTCTCATCAGGAGTCATCC<br>AGGAAGCCTTAGCCACAAATATGAAATTGAAGCAGGACATTGCTCGGCA<br>AAAGAGCAGCTTGGAGGCCACCCGTGAGATGGTGACCCGATTCATGGAG<br>ACAGCAGACAGTACTACAGCAGCAGTGCTGCAGGGCAAACTGGCAGAGG<br>TGAGCCAGCGGTTCGAACAGCTCTGTCTACAGCAGCAAGAAAAGGAGAG<br>CTCCCTAAAGAAGCTTCTACCCCAGGCAGAGATGTTTGAACACCTCTCTG<br>GTAAGCTGCAGCAGTTCATGGAAAACAAAAGTCGGATGCTGGCCTCTGG<br>AAATCAGCCAGATCAAGATATTACACATTTCTTCCAACAGATCAGGAGC<br>TCAATTTGGAAATGGAAGACCAACAGGAGAACCTAGATACTCTTGAGCA<br>CCTGGTCACTGAACTGAGCTCTTGTGGCTTTGCGCTGGACTTGTGCCAGC<br>ATCAGGACAGGGTACAGAATCTAAGAAAAGACTTCACAGAGCTACAGAA<br>GACAGTTAAAGAGAGAGAAAGATGCATCATCTTGCCAGGAACAGTTG<br>GATGAATTCCGGAAGCTGGTCAGGACCTTCCAGAAATGGTTGAAAGAAA<br>CTGAAGGGAGTATTCCACCTACGGAAACTTCTATGAGTGCTAAAGAGTTA<br>GAAAAGCAGATTGAACACCTGAAGAGTCTACTAGATGACTGGGCAAGTA<br>AGGGAACTCTGGTGGAAGAAATCAATTGCAAAGGTACTTCTTTAGAAAAT<br>CTCATCATGGAAATCACAGCACCTGATTCCCAAGGCAAGACAGGTTCCAT<br>ACTGCCCTCTGTAGGAAGCTCTGTAGGCAGTGTAAACGGATACCACACCT<br>GCAAAGATCTGACGGAGATCCAGTGTGACATGTCAGATGTAAACTTGAA<br>GTATGAGAAACTAGGGGGAGTACTTCATGAACGCCAGGAAAGCCTTCAG<br>GCTATCCTCAACAGAATGGAGGAGGTTCACAAGGAGGCAAACTCTGTGC<br>TGCAGTGGCTGGAATCAAAAGAGGAAGTCCTGAAATCCATGGATGCCAT<br>GTCATCTCCAACCAAGACAGAAACAGTGAAAGCCCAAGCTGAATCTAAC<br>AAGGCCTTCCTGGCTGAGTTGGAACAGAATTCTCCAAAAATTCAAAAAGT<br>AAAGGAAGCCCTGGCTGGATTACTGGTGACATATCCCAACTCACAGGAA<br>GCAGAAAATTGGAAGAAAATTCAGGAAGAACTCAATTCCCGATGGGAAA<br>GGGCCACTGAGGTTACTGTGGCTCGGCAAAGGCAGCTAGAGGAATCTGC<br>AAGTCATCTGGCCTGCTTCCAGGCTGCAGAATCCCAGCTCCGGCCGTGGC<br>TGATGGAGAAAGAACTGATGATGGGAGTGCTGGGGCCCCTGTCTATTGAC<br>CCCAACATGTTGAATGCACAAAAGCAACAGGTCCAGTTTATGCTAAAGG<br>AATTTGAAGCACGCAGGCAACAGCATGAGCAACTGAATGAGGCAGCTCA<br>GGGCATCCTAACAGGCCCTGGAGATGTCTCTCTGTCCACCAGCCAAGTAC<br>AGAAAGAACTCCAGAGCATCAATCAGAAATGGGTTGAGCTGACTGACAA<br>ACTCAACTCCCGTTCCAGCCAAATTGACCAAGCTATTGTTAAGAGCACCC<br>AGTACCAGGAACTGCTCCAGGACTTATCAGAGAAGGTGAGGGCAGTTGG<br>ACAACGGCTGAGTGTCCAGTCAGCTATCAGCACCCAACCAGAGGCTGTA<br>AAGCAGCAATTGGAAGAGACCAGTGAAATTCGATCTGACTTGGAGCAGT<br>TAGACCACGAGGTTAAGGAGGCTCAGACACTGTGCGATGAACTCTCAGT<br>GCTCATTGGTGAGCAGTACCTCAAGGATGAACTGAAGAAGCGTTTGGAG<br>ACAGTTGCCCTGCCTCTCCAAGGTTTAGAAGACCTTGCAGCCGATCGCAT<br>TAACAGACTCCAGGCAGCTCTTGCCAGCACCCAGCAGTTCCAGCAAATGT<br>TTGATGAGTTGAGGACCTGGTTGGATGATAAACAAAGCCAGCAAGCAAA<br>AAACTGCCCAATTTCTGCAAAATTGGAGCGGCTACAGTCTCAGCTACAGG<br>AGAATGAAGAGTTTCAGAAAAGTCTTAATCAACACAGTGGCTCCTATGAG<br>GTGATTGTGCTGAAGGGGAATCTCTACTTCTTTCTGTACCTCCTGGAGA<br>AGAGAAAAGGACTCTACAAAACCAGTTGGTTGAGCTCAAAAACCATTGG<br>GAAGAGCTTAGTAAAAAAACTGCAGACAGACAATCCAGGCTCAAGGATT<br>GTATGCAGAAAGCTCAGAAATATCAGTGGCATGTGGAAGACCTTGTGCC<br>ATGGATAGAAGATTGTAAAGCTAAGATGTCTGAGTTGCGAGTCACTCTGG<br>ATCCAGTGCAGCTAGAGTCCAGTCTCCTAAGATCAAAGGCTATGCTGAAT<br>GAGGTGGAGAAGCGCCGCTCCCTGCTGGAAATATTGAATAGTGCTGCTGA<br>CATTCTGATCAATTCTTCAGAAGCAGATGAGGATGGAATCCGGGATGAGA<br>AGGCTGGGATCAACCAGAACATGGATGCTGTTACAGAAGAGCTGCAGGC<br>CAAAACAGGGTCACTCGAAGAAATGACTCAGAGGCTCAGGGAGTTCCAG<br>GAAAGCTTTAAGAATATTGAAAAGAAGGTTGAAGGAGCCAAACACCAAC<br>TTGAGATCTTTGATGCTCTGGGTTCTCAAGCCTGTAGCAACAAGAACCTG<br>GAGAAGCTAAGAGCTCAACAGGAAGTGCTGCAGGCCCTAGAGCCTCAGG<br>TAGACTATCTGAGGAACTTTACTCAGGGTCTGGTAGAAGATGCCCCAGAT<br>GGATCTGATGCTTCTCAACTTCTCCACCAAGCTGAGGTCGCCCAGCAAGA<br>GTTCCTCGAAGTTAAGCAAAGAGTGAACAGTGGTTGTGTGATGATGGAA<br>AACAAGCTGGAGGGGATTGGCCAGTTTCACTGCCGGGTCCGAGAGATGTT<br>CTCTCAATTGGCAGACCTGGATGATGAGCTAGATGGCATGGGTGCTATTG<br>GCAGAGACACTGATAGCCTCCAGTCCCAAATCGAGGATGTCCGGCTATTC<br>CTTAACAAAATTCACGTCCTCAAATTAGACATAGAGGCCTCTGAAGCAGA<br>GTGTCGACATATGCTAGAAGAAGAGGGGACTCTGGATTTGTTAGGTCTCA<br>AAAGGGAGCTAGAAGCCCTGAACAAACAGTGTGGCAAACTGACAGAGAG<br>GGGGAAAGCTCGTCAGGAACAGCTGGAACTGACACTAGGCCGTGTAGAG<br>GACTTCTACAGGAAATTGAAAGGACTCAATGACGCGACCACAGCAGCAG<br>AGGAGGCAGAGGCCCTCCAGTGGGTAGTGGGGACCGAAGTGGAAATCAT<br>CAACCAACAATTAGCAGATTTTAAAATGTTTCAGAAAGAACAAGTGGATC<br>CTCTTCAGATGAAATTGCAGCAGGTGAATGGACTTGGCCAGGGATTAATT<br>CAGAGTGCAGGAAAAGACTGTGATGTACAGGGTTTAGAACATGACATGG<br>AAGAGATCAATGCTCGATGGAATACATTGAATAAAAAGGTCGCACAAAG | |

TABLE B-continued

| Gene Fusion | Chimera Sequence | SEQ ID NO. |
|---|---|---|
| | AATTGCACAGCTACAGGAAGCTTTGTTGCATTGTGGGAAGTTTCAAGATG<br>CCTTGGAGCCATTGCTCAGCTGGTTGGCAGATACCGAGGAGCTCATAGCC<br>AATCAGAAACCTCCATCTGCTGAGTATAAAGTGGTGAAAGCACAGATCC<br>AAGAACAGAAGTTGCTCCAGCGGCTCCTAGATGATCGAAAGGCCACAGT<br>AGACATGCTTCAAGCAGAAGGAGGCAGAATAGCCCAGTCAGCAGAGCTG<br>GCTGATAGAGAGAAAATCACTGGACAGCTGGAGAGTCTTGAAAGTAGAT<br>GGACTGAACTACTCAGTAAGGCAGCAGCCAGGCAAAAACAGCTGGAAGA<br>CATCCTGGTTCTGGCCAAACAGTTCCATGAGACAGCTGAGCCTATTTCTG<br>ACTTCTTATCTGTCACAGAGAAAAAGCTTGCTAACTCAGAACCTGTTGGC<br>ACTCAGACTGCCAAAATACAGCAGCAGATCATTCGGCACAAGGCTCTGG<br>AAGAAGACATAGAAACCATGCAACAGATGTGCACCAGGCAGTCAAAAT<br>TGGGCAGTCCCTCTCCTCCCTGACATCTCCTGCAGAACAGGGTGTGCTGT<br>CAGAAAAGATAGACTCATTGCAGGCCCGATACAGTGAAATTCAAGACCG<br>CTGTTGTCGGAAGGCAGCCCTACTTGACCAAGCTCTGTCTAATGCTAGGC<br>TGTTTGGGGAGGATGAGGTGGAGGTGCTCAACTGGCTGGCTGAGGTTGA<br>GGACAAGCTCAGTTCAGTGTTCGTAAAGGATTTCAAACAGGATGTCCTGC<br>ACAGGCAGCATGCTGACCACCTGGCTTTAAATGAAGAAATTGTTAATAGA<br>AAGAAGAATGTAGATCAAGCTATTAAAAATGGTCAGGCTCTTCTAAAAC<br>AAACCACAGGTGAGGAGGTGTTACTTATCCAGGAAAAACTAGATGGTAT<br>AAAGACTCGTTACGCAGACATCACAGTTACTAGCTCCAAGGCCCTCAGAA<br>CTTTAGAGCAAGCCCGGCAGCTGGCCACCAAGTTCCAGTCTACTTATGAG<br>GAACTGACCGGGTGGCTGAGGGAGGTGGAGGAGGAGCTGGCAACCAGTG<br>GAGGACAGTCTCCCACAGGGGAACAGATACCCCAGTTTCAGCAGAGACA<br>GAAGGAATTAAAGAAGGAGGTCATGGAGCACAGGCTGGTGTTGGACACA<br>GTGAATGAGGTGAGCCGTGCTCTCTTAGAGCTGGTGCCCTGGAGAGCCAG<br>AGAAGGGCTGGATAAACTTGTGTCCGATGCTAACGAGCAGTACAAACTA<br>GTCAGTGACACTATTGGACAAAGGGTGGATGAAATTGATGCTGCTATTCA<br>GAGATCACAACAGTATGAGCAAGCTGCCGATGCAGAACTAGCTTGGGTT<br>GCTGAAACAAAACGGAAACTGATGGCTCTGGGTCCAATTCGCCTGGAAC<br>AGGACCAGACCACAGCTCAGCTTCAGGTACAGAAGGCTTTCTCCATTGAC<br>ATTATTCGACACAAAGATTCAATGGATGAACTCTTCAGTCACCGTAGTGA<br>AATCTTTGGCACATGTGGGGAGGAGCAAAAAACTGTATTACAGGAAAAG<br>ACAGAGTCTCTAATACAGCAATATGAAGCCATTAGCCTACTCAATTCAGA<br>GCGTTATGCCCGCCTAGAGCGGGCCCAGGTCTTAGTAAACCAGTTTTGGG<br>AAACTTATGAAGAGCTCAGCCCCTCGGATTGAGGAAACTCGGGCACTAAT<br>AGCACAGTTACCCTCTCCAGCCATTGATCATGAGCAGCTCAGGCAGCAAC<br>AAGAGGAAATGAGGCAATTAAGGGAATCTATTGCTGAACACAAACCTCA<br>TATTGACAAACTACTAAAGATAGGCCCACAACTAAAGGAATTAAACCCT<br>GAGGAAGGGGAAATGGTGGAAGAAAAATACCAGAAAGCAGAAAACATG<br>TATGCCCAAATAAAGGAGGAGGTGCGCCAGCGAGCCCTGGCTCTGGATG<br>AAGCCGTGTCCCAGTCCACACAGATTACAGAGTTTCATGATAAAATTGAG<br>CCTATGTTGGAGACACTGGAGAATCTTTCCTCTCGCCTGCGTATGCCACC<br>ACTGATCCCTGCTGAAGTAGACAAGATCAGAGAGTGCATCAGTGACAAT<br>AAGAGTGCCACCGTGGAGCTAGAAAAACTGCAGCCATCCTTTGAGGCCTT<br>GAAGCGCCGTGGAGAGGAGCTTATTGGACGATCTCAGGGAGCAGACAAG<br>GATCTGGCTGCAAAAGAAATCCAGGATAAATTGGATCAAATGGTATTCTT<br>CTGGGAGGACATCAAAGCTCGGGCTGAAGAACGAGAAATCAAATTTCTT<br>GATGTCCTTGAATTAGCAGAGAAGTTCTGGTATGACATGGCAGCTCTCCT<br>GACCACCATCAAAGACACCCAGGATATTGTCCATGACTTGGAAAGCCCA<br>GGCATTGATCCTTCCATCATCAAACAACAGGTTGAAGCTGCTGAGACTAT<br>TAAGGAAGAGACAGATGGTCTGCATGAAGAGCTGGAGTTTATTCGGATC<br>CTTGGAGCAGATTTGATTTTTGCCTGTGGAGAAACTGAGAAGCCTGAAGT<br>GAGGAAGAGCATTGATGAGATGAATAATGCTTGGGAGAACTTAAACAAA<br>ACATGGAAAGAGAGGCTAGAAAAACTTGAGGATGCTATGCAAGCTGCTG<br>TGCAGTATCAGGACACTCTTCAGGCTATGTTTGACTGGCTAGATAACACT<br>GTGATTAAACTCTGCACCATGCCCCCTGTTGGCACTGACCTCAATACTGTT<br>AAAGATCAGTTAAATGAAATGAAGGAGTTCAAAGTAGAAGTTTACCAAC<br>AGCAAATTGAGATGGAGAAGCTTAATCACCAGGGTGAACTGATGTTAAA<br>GAAAGCTACTGATGAGACGGACAGAGACATTATACGAGAACCACTGACA<br>GAACTCAAACACCTCTGGGAGAACCTGGGTGAGAAAATTGCCCACCGAC<br>AGCACAAACTAGAAGGGGCTCTGTTGGCCCTTGGTCAGTTCCAGCATGCC<br>TTAGAGGAACTAATGAGTTGGCTGACTCATACCGAAGAGTTGTTAGATGC<br>TCAGAGACCAATAAGTGGAGACCCAAAAGTCATTGAAGTTGAGCTCGCA<br>AAGCACCATGTCCTAAAAAATGATGTTTTGGCTCATCAAGCCACAGTGGA<br>AACAGTCAACAAAGCTGGCAATGAGCTTCTTGAATCCAGTGCTGGAGATG<br>ATGCCAGCAGCTTAAGGAGCCGTTTGGAAGCCATGAACCAATGCTGGGA<br>GTCAGTGTTACAGAAAACAGAGGAGAGGGAGCAGCAGCTTCAGTCAACT<br>CTGCAGCAGGCCCAGGGCTTCCACAGTGAAATTGAAGATTTCCTCTTGGA<br>ACTTACTAGAATGGAGAGCCAGCTTTCTGCATCTAAGCCCACAGGAGGAC<br>TTCCTGAAACTGCTAGGGAACAGCTTGATACACATATGGAACTCTATTCC<br>CAGCTGAAAGCCAAGGAAGAGACTTATAATCAACTACTTGACAAGGGCA<br>GACTCATGCTTCTAAGCCGTGACGACTCTGGGTCTGGCTCCAAGACAGAA<br>CAGAGTGTAGCACTTTTGGAGCAGAAGTGGCATGTGGTCAGCAGTAAGA<br>TGGAAGAAAGAAAGTCAAAGCTGGAAGAGGCCCTCAACTTGGCAACAGA<br>ATTCCAGAATTCCCTACAAGAATTTATCAACTGGCTCACTCTAGCAGAGC<br>AGAGTTTAAACATCGCTTCTCCACCAAGCCTGATTCTAAATACTGTCCTTT<br>CCCAGATAGAAGAGCACAAGGTTTTTGCTAATGAAGTAAATGCTCATCGA | |

TABLE B-continued

| Gene Fusion | Chimera Sequence | SEQ ID NO. |
|---|---|---|
| | GACCAGATCATTGAGCTGGATCAAACTGGGAATCAATTAAAGTTCCTTAG CCAAAAGCAGGATGTTGTTCTGATCAAGAATTTGTTGGTGAGCGTGCAGT CTCGATGGGAGAAGGTTGTCCAGCGATCTATTGAAAGAGGGCGATCACT AGATGATGCCAGGAAGCGGGCAAAACAATTCCATGAAGCTTGGAAAAAA CTGATTGACTGGCTAGAAGATGCAGAGAGTCACCTGGACTCAGAACTAG AGATATCCAATGACCCAGACAAAATTAAACTTCAGCTTTCTAAGCATAAG GAGTTTCAGAAGACTCTTGGTGGCAAGCAGCCTGTGTATGATACCACAAT TAGAACTGGCAGAGCACTGAAAGAAAAGACTTTGCTTCCCGAAGATAGT CAGAAACTTGACAATTTCCTAGGAGAAGTCAGAGACAAATGGGATACTG TTTGTGGCAAGTCTGTGGAGCGGCAGCACAAGTTGGAGGAAGCCCTGCTC TTTTCGGGTCAGTTCATGGATGCTTTGCAGGCATTGGTTGACTGGTTATAC AAGGTGGAGCCACAGCTGGCTGAGGACCAGCCCGTGCACGGGGACCTTG ACCTCGTCATGAACCTCATGGATGCACACAAGGTTTTCCAGAAGGAACTG GGAAAGCGAACAGGAACCGTTCAGGTCCTGAAGCGGTCAGGCCGAGAGC TGATTGAGAATAGTCGAGATGACACCACTTGGGTAAAAGGACAGCTCCA GGAACTGAGCACTCGCTGGGACACTGTCTGTAAACTCTCTGTTTCCAAAC AAAGCCGGCTTGAGCAGGCCTTAAAACAAGCGGAAGTGTTTCGAGACAC AGTCCACATGCTGTTGGAGTGGCTTTCTGAAGCAGAGCAAACGCTTCGCT TTCGGGGAGCACTTCCTGATGACACAGAGGCCCTGCAGTCTCTCATTGAC ACCCATAAGGAATTCATGAAGAAAGTAGAAGAAAAAGCGAGTGGACGTTA ACTCAGCAGTAGCCATGGGAGAAGTCATCCTGGCTGTCTGCCACCCCGAT TGCATCACAACCATCAAACACTGGATCACCATCATCCGAGCTCGCTTCGA GGAGGTCCTGACATGGGCTAAGCAGCACCAGCAGCGTCTTGAAACGGCC TTGTCAGAACTGGTGGCTAATGCTGAGCTCCTGGAAGAACTTCTGGCATG GATCCAGTGGGCTGAGACCACCCTCATTCAGCGGGATCAGGAGCCAATCC CGCAGAACATTGACCGAGTTAAAGCCCTTATCGCTGAGCATCAGACATTT ATGGAGGAGATGACTCGCAAACAGCTGACGTGGACCGGGTCACCAAGA CATACAAAAGGAAAAACATAGAGCCTACTCACGCGCCTTTCATAGAGAA ATCCCGCAGCGGAGGCAGGAAATCCCTAAGTCAGCCAACCCCTCCTCCCA TGCCAATCCTTTCACAGTCTGAAGCAAAAAACCCACGGATCAACCAGCTT TCTGCCCGCTGGCAGCAGGTGTGGCTGTTAGCACTGGAGCGGCAAAGGA AACTGAATGATGCCTTGGATCGGCTGGAGGAGTTGAAAGAATTTGCCAAC TTTGACTTTGATGTCTGGAGGAAAAAGTATATGCGTTGGATGAATCACAA AAAGTCTCGAGTGATGGATTTCTTCCGGCGCATTGATAAGGACCAGGATG GGAAGATAACACGTCAGGAGTTTATCGATGGCATTTTAGCATCCAAGTTC CCCACCACCAAGTTAGAGATGACTGCTGTGGCTGACATTTTCGACCGAGA TGGGGATGGTTACATTGATTATTATGAATTTGTGGCTGCTCTTCATCCCAA CAAGGATGCGTATCGACCAACAACCGATGCAGATAAAATCGAAGATGAG GTTACAAGACAAGTGGCTCAGTGCAAATGTGCAAAAAGGTTTCAGGTGG AGCAGATCGGAGAGAATAAATACCGGTTTGGGGATTCTCAGCAGTTGCG GCTGGTCCGTATTCTGCGCAGCACCGTGATGGTTCGCGTTGGTGGAGGAT GGATGGCCTTGATGAATTTTTAGTGAAAAATGATCCCTGCCGAGCACGA GGTAGAACTAACATTGAACTTAGAGAGAATTCATCCTACCAGAGGGAG CATCCCAGGGAATGACCCCCTTCCGCTCACGGGGTCGAAGGTCCAAACCA TCTTCCCGGGCAGCTTCCCCTACTCGTTCCAGCTCCAGTGCTAGTCAGAGT AACCACAGCTGTACATCCATGCCATCTTCTCCAGCCACCCCAGCCAGTGG AACCAAGGTTATCCCATCATCAGGTAGCAAGTTGAAACGACCAACACCA ACTTTTCATTCTAGTCGGACATCCCTTGCTGGTGATACCAGCAATAGTTCT TCCCCGGCCTCCACAGGTGCCAAAACTAATGGGCAGACCCTAAAAAGTC TGCCAGTCGCCCTGGGAGTCGGGCTGGGAGTCGAGCGGGAGTCGAGCC AGCAGCCGGCGAGGAAGTGACGCTTCTGACTTTGACCTCTTAGAGACGCA GTCTGCTTGTTCCGACACTTCAGAAAGCAGCGCTGCAGGGGGCCAAGGCA ACTCCAGGAGAGGGCTAAACAAACCTTCCAAAATCCCAACCATGTCTAA GAAGACCACCACTGCCTCCCCCAGGACTCCAGGTCCCAAGCGATAA | |
| PGAP3-> CACNB1 | ATGGCCGGCCTGGCGGCGCGGTTGGTCCTGCTAGCTGGGGCAGCGGCGCT GGCGAGCGGCTCCCAGGGCGACCGTGAGCCGGTGTACCGCGACTGCGTA CTGCAGTGCGAAGAGCAGAACTGCTCTGGGGCGCTCTGAATCACTTCCG CTCCCGCCAGCCAATCTACATGAGTCTAGCAGGCTGGACCTGTCGGGACG ACTGTAAGTATGAGTGTATGTGGGTCACCGTTGGGCTCTACCTCCAGGAA GGTCACAAAGTGCCTCAGTTCCATGGCAAGTGGCCCTTCTCCCGGTTCCT GTTCTTTTCAAGAGCCGGCATCGGCCGTGGCCTCGTTTCTCAATGGCCTGG CCAGCCTGGTGATGCTCTGCCGCTACCGCACCTTCGTGCCAGCCTCCTCCC CCATGTACCACACCTGTGTGGCCTTCGCCTGGGAAATGTTTGACATCATC CTGGATGAGAACCAATTGGAGGATGCCTGCGAGCATCTGGCGGAGTACTT GGAAGCCTATTGGAAGGCCACACACCCCGCCAGCAGCACGCCACCCAAT CCGCTGCTGAACCGCACCATGGCTACCGCAGCCCTGGCTGCCAGCCCTGC CCCTGTCTCCAACCTCCAGGGACCCTACCTTGCTTCCGGGGACCAGCCAC TGGAACGGGCCACCGGGGAGCACGCCAGCATGCACGAGTACCAGGGGA GCTGGGCCAGCCCCAGGCCTTTACCCCAGCAGCCACCCACCAGGCCGGG CAGGCACGCTACGGGCACTGTCCCGCCAAGACACTTTTGATGCCGACACC CCCGGCAGCCGAAACTCTGCCTACACGGAGCTGGGAGACTCATGTGTGG ACATGGAGACTGACCCCTCAGAGGGGCCAGGGCTTGGAGACCCTGCAGG GGCGGCACGCCCCAGCCCGACAGGGATCCGGGAGGACGAGGAAGAA GACTATGAGGAAGAGCTGACCGACAACCGGAACCGGGGCCGGAATAAGG CCCGCTACTGCGCTGAGGGTGGGGGTCCAGTTTTGGGGCGCAACAAGAAT GAGCTGGAGGGCTGGGACGAGGCGTCTACATTCGCTGA | SEQ ID NO: 23 |

TABLE B-continued

| Gene Fusion | Chimera Sequence | SEQ ID NO. |
|---|---|---|
| STAU1-> TOP1 | CACTTCCTGCCGGGCTGCGGGCGCCTGAGCGGCTCTTCAGCGTTTGCGCC GGCGGCTGCCGCGTCTCTCTCGGCTCCCGCTTCCTTTGACCGCCTCCCCCC CCCGGCCCGGCGGCGCCCGCCTCCTCCACGGCCACTCCGCCTCTTCCCTC CCTTCGTCCCTTCTTCCTCTCCCTTTTTTCCTTCTTCCTTCCCCTCCTCGCCG CCACCGCCCAGGACCGCCGGCCGGGGGACGAGCTCGGAGCAGCAGCCAG GTGGAGTTTTGCTCTTGTCGCCCAGGCTGGAGTGCAGTGGCGTGATCTCG GCTCACTGCAACCTCCACCTCCCAGGTTCAAGCGATTTTCCCACTTCAGCC TCCCGATAAGCTGAGATTACAGAGTTTATTAACCACTTAACCTCTCAGAA CTGAACAAAGACAACATTGTTCCTGGAACGCCCTCTTTTTAAAAAAGATT CTCATAAACACAAAGATAAACACAAAGATCGAGAACACCGGCACAAAGA ACACAAGAAGGAGAAGGACCGGGAAAAGTCCAAGCATAGCAACAGTGA ACATAAAGATTCTGAAAAGAAACACAAAGAGAAGGAGAAGACCAAACA CAAAGATGGAAGCTCAGAAAAGCATAAAGACAAACATAAAGACAGAGA CAAGGAAAAACGAAAAGAGGAAAAGGTTCGAGCCTCTGGGGATGCAAA AATAAAGAAGGAGAAGGAAATGGCTTCTCTAGTCCACCACAAATTAAA GATGAACCTGAAGATGATGGCTATTTTGTTCCTCCTAAAGAGGATATAAA GCCATTAAAGAGACCTCGAGATGAGGATGATGCTGATTATAAACCTAAG AAAATTAAAACAGAAGATACCAAGAAGGAGAAGAAAAGAAAACTAGAA GAAGAAGAGGATGGTAAATTGAAAAAACCCAAGAATAAAGATAAAGAT AAAAAAGTTCCTGAGCCAGATAACAAGAAAAAGAAGCCGAAGAAAGAA GAGGAACAGAAGTGGAAATGGTGGGAAGAAGAGCGCTATCCTGAAGGC ATCAAGTGGAAATTCCTAGAACATAAAGGTCCAGTATTTGCCCCACCATA TGAGCCTCTTCCAGAGAATGTCAAGTTTTATTATGATGGTAAAGTCATGA AGCTGAGCCCCAAAGCAGAGGAAGTAGCTACGTTCTTTGCAAAAATGCTC GACCATGAATATACTACCAAGGAAATATTTAGGAAAAATTTCTTTAAAGA CTGGAGAAAGGAAATGACTAATGAAGAGAAGAATATTATCACCAACCTA AGCAAATGTGATTTTACCCAGATGAGCCAGTATTTCAAAGCCCAGACGGA AGCTCGGAAACAGATGAGCAAGGAAGAGAAACTGAAAATCAAAGAGGA GAATGAAAAATTACTGAAAGAATATGGATTCTGTATTATGGATAACCACA AAGAGAGGATTGCTAACTTCAAGATAGAGCCTCCTGGACTTTTCCGTGGC CGCGGCAACCACCCCAAGATGGGCATGCTGAAGAGACGAATCATGCCCG AGGATATAATCATCAACTGTAGCAAAGATGCCAAGGTTCCTTCTCCTCCT CCAGGACATAAGTGGAAAGAAGTCCGGCATGATAACAAGGTTACTTGGC TGGTTTCCTGGACAGAGAACATCCAAGGTTCCATTAAATACATCATGCTT AACCCTAGTTCACGAATCAAGGGTGAGAAGGACTGGCAGAAATACGAGA CTGCTCGGCGGCTGAAAAAATGTGTGGACAAGATCCGGAACCAGTATCG AGAAGACTGGAAGTCCAAAGAGATGAAAGTCCGGCAGAGAGCTGTAGCC CTGTACTTCATCGACAAGCTTGCTCTGAGAGCAGGCAATGAAAAGGAGG AAGGAGAAACAGCGGACACTGTGGGCTGCTGCTCACTTCGTGTGGAGCA CATCAATCTACACCCAGAGTTGGATGGTCAGGAATATGTGGTAGAGTTTG ACTTCCTCGGGAAGGACTCCATCAGATACTATAACAAGGTCCCTGTTGAG AAACGAGTTTTTAAGAACCTACAACTATTTATGGGAGAACAAGCAGCCCGA GGATGATCTTTTTGATAGACTCAATACTGGTATTCTGAATAAGCATCTTCA GGATCTCATGGAGGGCTTGACAGCCAAGGTATTCCGTACATACAATGCCT CCATCACGCTACAGCAGCAGCTAAAAGAACTGACAGCCCCGGATGAGAA CATCCCAGCGAAGATCCTTTCTTATAACCGTGCCAATCGAGCTGTTGCAA TTCTTTGTAACCATCAGAGGGCACCACCAAAAACTTTTGAGAAGTCTATG ATGAACTTGCAAACTAAGATTGATGCCAAGAAGGAACAGCTAGCAGATG CCCGGAGAGACCTGAAAAGTGCTAAGGCTGATGCCAAGGTCATGAAGGA TGCAAAGACGAAGAAGGTAGTAGAGTCAAAGAAGAAGGCTGTTCAGAGA CTGGAGGAACAGTTGATGAAGCTGGAAGTTCAAGCCACAGACCGAGAGG AAAATAAACAGATTGCCCTGGGAACCTCCAAACTCAATTATCTGGACCCT AGGATCACAGTGGCTTGGTGCAAGAAGTGGGGTGTCCCAATTGAGAAGA TTTACAACAAAACCCAGCGGGAGAAGTTTGCCTGGGCCATTGACATGGCT GATGAAGACTATGAGTTTTAGCCAGTCTCAAGAGGCAGAGTTCTGTGAAG AGGAACAGTGTGGTTTGGGAAAGATGGATAAACTGAGCCTCACTTGCCCT CGTGCCTGGGGAGAGAGGCAGCAAGTCTTAACAAACCAACATCTTTGC GAAAAGATAAACCTGGAGATATTATAAGGGAGAGCTGAGCCAGTTGTCC TATGGACAACTTATTTAAAAATATTTCAGATATCAAAATTCTAGCTGTAT GATTTGTTTTGAATTTGTTTTTATTTTCAAGAGGGCAAGTGGATGGGAAT TTGTCAGCGTTCTACCAGGCAAATTCACTGTTTCACTGAAATGTTTGGATT CTCTTAGCTACTGTATGCAAAGTCCGATTATATTGGTGCGTTTTACAGTT AGGGTTTTGCAATAACTTCTATATTTTAATAGAAATAAATTCCTAAACTCC CTTCCCTCTCTCCCATTTCAGGAATTTAAAATTAAGTAGAACAAAAAACC CAGCGCACCTGTTAGAGTCGTCACTCTCTATTGTCATGGGGATCAATTTTC ATTAAACTTGAAGCAGTCGTGGCTTTGGCAGTGTTTTGGTTCAGACACCT GTTCACAGAAAAAGCATGATGGGAAATATTTCCTGACTTGAGTGTTCCT TTTTAAATGTGAATTTTTATTCTTTTTAATTATTTTAAAATATTTAAACCT TTTTCTTGATCTTAAAGATCGTGTAGATTGGGGTTGGGGAGGGATGAAGG GCGAGTGAATCTAAGGATAATGAAATAATCAGTGACTGAAACCATTTTCC CATCATCCTTTGTTCTGAGCATTCGCTGTACCCTTTAAGATATCCATCTTTT TCTTTTTAACCCTAATCTTTCACTTGAAAGATTTTATTGTATAAAAAGTTT CACAGGTCAATAAACTTAGAGGAAATGAGTATTGGTCCAAAAAAGG AAAAATAATCAAGATTTTAGGGCTTTTATTTTTTCTTTTGTAATTGTGTAA AAAATGGAAAAAACATAAAAAGCAGAATTTTAATGTGAAGACATTTTT TGCTATAATCATTAGTTTTAGAGGCATTGTTAGTTTAGTGTGTGTGCAGAG | SEQ ID NO: 24 |

TABLE B-continued

| Gene Fusion | Chimera Sequence | SEQ ID NO. |
|---|---|---|
| | TCCATTTCCCACATCTTTCCTCAAGTATCTTCTATTTTTATCATGAATTCCC TTTTAATCAACTGTAGGTTATTTAAAATAAATTCCTACAACTTAATGGAAA | |
| FBXW7-> MLL3 | ATGAATCAGGAACTGCTCTCTGTGGGCAGCAAAAGACGACGAACTGGAG GCTCTCTGAGAGGTAACCCTTCCTCAAGCCAGGTAGATGAAGAACAGATG AATCGTGTGGTAGAGGAGGAACAGCAACAGCAACTCAGACAACAAGAGG AGGAGCACACTGCAAGGAATGGTGAAGTTGTTGGAGTAGAACCTAGACC TGGAGGCCAAAATGATTCCCAGCAAGGACAGTTGGAAGAAAACAATAAT AGATTTATTTCGGTAGATGAGGACTCCTCAGGAAACCAAGAAGAACAAG AGGAAGATGAAGAACATGCTGGTGAACAAGATGAGGAGGATGAGGAGG AGGAGGAGATGGACCAGGAGAGTGACGATTTTGATCAGTCTGATGATAG TAGCAGAGAAGATGAACATACACATACTAACAGTGTCACGAACTCCAGT AGTATTGTGGACCTGCCCGTTCACCAACTCTCCTCCCCATTCTATACAAAA ACAACAAAAACCTCGAAGTAGGGGGAAAACTGCAGTGGAAGATGAGGA CAGCATGGATGGGCTGGAGACAACAGAAACAGAAACGATTGTGGAAACA GAAATCAAAGAACAATCTGCAGAAGAGGATGCTGAAGCAGAAGTGGATA ACAGCAAACAGCTAATTCCAACTCTTCAGCGATCTGTGTCTGAGGAATCG GCAAACTCCCTGGTCTCTGTTGGTGTAGAAGCCAAAATCAGTGAACAGCT CTGCGCTTTTTGTTACTGTGGGGAAAAAAGTTCCTTAGGACAAGGAGACT TAAAACAATTCAGAATAACGCCTGGATTTATCTTGCCATGGAGAAACCAA CCTTCTAACAAGAAGGACATTGATGACAACAGCAATGGAACCTATGAGA AATGCAAAACTCAGCACCACGAAAACAAAGAGGACAGAGAAAAGAAC GATCTCCTCAGCAGAATATAGTATCTTGTGTAAGTGTAAGCACCCAGACA GCTTCAGATGATCAAGCTGGTAAACTGTGGGATGAACTCAGTCTGGTTGG GCTTCCAGATGCCATTGATATCCAAGCCTTATTTGATTCTACAGGCACTTG TTGGGCTCATCACCGTTGTGTGGAGTGGTCACTAGGAGTATGCCAGATGG AAGAACCATTGTTAGTGAACGTGGACAAAGCTGTTGTCTCAGGGAGCAC AGAACGATGTGCATTTTGTAAGCACCTTGGAGCCACTATCAAATGCTGTG AAGAGAAATGTACCCAGATGTATCATTATCCTTGTGCTGCAGGAGCCGGC ACCTTTCAGGATTTCAGTCACATCTTCCTGCTTTGTCCAGAACACATTGAC CAAGCTCCTGAAAGATCGAAGGAAGATGCAAACTGTGCAGTGTGCGACA GCCCGGGAGACCTCTTAGATCAGTTCTTTTGTACTACTTGTGGTCAGCACT ATCATGGAATGTGCCTGGATATAGCGGTTACTCCATTAAAACGTGCAGGT TGGCAATGTCCTGAGTGCAAAGTGTGCCAGAACTGCAAACAATCGGGAG AAGATAGCAAGATGCTAGTGTGTGATACGTGTGACAAAGGGTATCATACT TTTTGTCTTCAACCAGTTATGAAATCAGTACCAACCAATGGCTGGAAATG CAAAAATTGCAGAATATGTATAGAGTGTGGCACACGGTCTAGTTCTCAGT GGCACCACAATTGCCTGATATGTGACAATTGTTACCAACAGCAGGATAAC TTATGTCCCTTCTGTGGGAAGTGTTATCATCCAGAATTGCAGAAAGACAT GCTTCATTGTAATATGTGCAAAAGGTGGGTTCACCTAGAGTGTGACAAAC CAACAGATCATGAACTGGATACTCAGCTCAAAGAAGAGTATATCTGCATG TATTGTAAACACCTGGGAGCTGAGATGGATCGTTTACAGCCAGGTGAGGA AGTGGAGATAGCTGAGCTCACTACAGATTATAACAATGAAATGGAAGTT GAAGGCCCTGAAGATCAAATGGTATTCTCAGAGCAGGCAGCTAATAAAG ATGTCAACGGTCAGGAGTCCACTCCTGGAATTGTTCCAGATGCGGTTCAA GTCCACACTGAAGAGCAACAGAAGAGTCATCCCTCAGAAAGTCTTGACA CAGATAGTCTTCTTATTGCTGTATCATCCCAACATACAGTGAATACTGAAT TGGAAAAACAGATTTCTAATGAAGTTGATAGTGAAGACCTGAAAATGTCT TCTGAAGTGAAGCATATTTGTGGCGAAGTCAAATTGAAGATAAAATGG AAGTGACAGAAAACATTGAAGTCGTTACACACCAGATCACTGTGCAGCA AGAACAACTGCAGTTGTTAGAGGAACCTGAAACAGTGGTATCCAGAGAA GAATCAAGGCCTCCAAAATTAGTCATGGAATCTGTCACTCTTCCACTAGA AACCTTAGTGTCCCCACATGAGGAAAGTATTTCATTATGTCCTGAGGAAC AGTTGGTTATAGAAAGGCTACAAGGAGAAAAGGAACAGAAAGAAAATTC TGAACTTTCTACTGGATTGATGGACTCTGAAATGACTCCTACAATTGAGG GTTGTGTGAAAGATGTTTCATACCAAGGAGGCAAATCTATAAAGTTATCA TCTGAGACAGAGTCATCATTTTCATCATCAGCAGACATAAGCAAGGCAGA TGTGTCTTCCTCCCCAACACCTTCTTCAGACTTGCCTTCGCATGACATGCT GCATAATTACCCTTCAGCTCTTAGTTCCTCTGCTGGAAACATCATGCCAAC AACTTACATCTCAGTCACTCCAAAAATTGGCATGGGTAAACCAGCTATTA CTAAGAGAAAATTTTCTCCTGGTAGACCTCGGTCCAAACAGGGGGCTTGG AGTACCCATAATACAGTGAGCCCACCTTCCTGGTCCCCAGACATTTCAGA AGGTCGGGAAATTTTTAAACCCAGGCAGCTTCCTGGCAGTGCCATTTGGA GCATCAAAGTGGGCCGTGGGTCTGGATTTCCAGGAAAGCGGAGACCTCG AGGTGCAGGACTGTCGGGGCGAGGTGGCCGAGGCAGGTCAAAGCTGAAA AGTGGAATCGGAGCTGTTGTATTACCTGGGGTGTCTACTGCAGATATTTC ATCAAATAAGGATGATGAAGAAACTCTATGCACAATACAGTTGTGTTGT TTTCTAGCAGTGACAAGTTCACTTTGAATCAGGATATGTGTAGTTTGTG GCAGTTTTGGCCAAGGAGCAGAAGGAAGATTACTTGCCTGTTCTCAGTGT GGTCAGTGTTACCATCCATACTGTGTCAGTATTAAGATCACTAAAGTGGT TCTTAGCAAAGGTTGGAGGTGTCTTGAGTGCACTGTGTGTGAGGCCTGTG GGAAGGCAACTGACCCAGGAAGACTCCTGCTGTGTGATGACTGTGACAT AAGTTATCACACCTACTGCCTAGACCCTCCATTGCAGACAGTTCCCAAAG GAGGCTGGAAGTGCAATGGTGTGTTGGTGCAGACACTGTGGAGCAAC ATCTGCAGGTCTAAGATGAATGGCAGAACAATTACACACAGTGCGCTC CTTGTGCAAGCTTATCTTCCTGTCCAGTCTGCTATCGAAACTATAGAGAA GAAGATCTTATTCTGCAATGTAGACAATGTGATAGATGGATGCATGCAGT | SEQ ID NO: 25 |

TABLE B-continued

| Gene Fusion | Chimera Sequence | SEQ ID NO. |
|---|---|---|
| | TTGTCAGAACTTAAATACTGAGGAAGAAGTGGAAAATGTAGCAGACATT GGTTTTGATTGTAGCATGTGCAGACCCTATATGCCTGCGTCTAATGTGCCT TCCTCAGACTGCTGTGAATCTTCACTTGTAGCACAAATTGTCACAAAAGT AAAAGAGCTAGACCCACCCAAGACTTATACCCAGGATGGTGTGTGTTTGA CTGAATCAGGGATGACTCAGTTACAGAGCCTCACAGTTACAGTTCCAAGA AGAAAACGGTCAAAACCAAAATTGAAATTGAAGATTATAAATCAGAATA GCGTGGCCGTCCTTCAGACCCCTCCAGACATCCAATCAGAGCATTCAAGG GATGGTGAAATGGATGATAGTCGAGAAGGAGAACTTATGGATTGTGATG GAAAATCAGAATCTAGTCCTGAGCGGGAAGCTGTGGATGATGAAACTAA GGGAGTGGAAGGAACAGATGGTGTCAAAAAGAGAAAAAGGAAACCATA CAGACCAGGTATTGGTGGATTTATGGTGCGGCAAAGAAGTCGAACTGGG CAAGGGAAAACCAAAAGATCTGTGATCAGAAAAGATTCCTCAGGCTCTA TTTCCGAGCAGTTACCTTGCAGAGATGATGGCTGGAGTGAGCAGTTACCA GATACTTTAGTTGATGAATCTGTTTCTGTTACTGAAAGCACTGAAAAAAT AAAGAAGAGATACCGAAAAAGGAAAAATAAGCTTGAAGAAACTTTCCCT GCCTATTTACAAGAAGCTTTCTTTGGAAAAGATCTTCTAGATACAAGTAG ACAAAGCAAGATAAGTTTAGATAATCTGTCAGAAGATGGAGCTCAGCTTT TATATAAAACAAACATGAACACAGGTTTCTTGGATCCTTCCTTAGATCCA CTACTTAGTTCATCCTCGGCTCCAACAAAATCTGGAACTCACGGTCCTGCT GATGACCCATTAGCTGATATTTCTGAAGTTTTAAACACAGATGATGACAT TCTTGGAATAATTTCAGATGATCTAGCAAAATCAGTTGATCATTCAGATA TTGGTCCTGTCACTGATGATCCTTCCTCTTTGCCTCAGCCAAATGTCAATC AGAGTTCACGACCATTAAGTGAAGAACAGCTAGATGGGATCCTCAGTCCT GAACTAGACAAAATGGTCACAGATGGAGCAATTCTTGGAAAATTATATA AAATTCCAGAGCTTGGCGGAAAAGATGTTGAAGACTTATTTACAGCTGTA CTTAGTCCTGCGAACACTCAGCCAACTCCATTGCCACAGCCTCCCCCACC AACACAGCTGTTGCCAATACACAATCAGGATGCTTTTTCACGGATGCCTC TCATGAATGGCCTTATTGGATCCAGTCCTCATCTCCCACATAATTCTTTGC CACCTGGAAGCGGACTGGGAACTTTCTCTGCAATTGCACAATCCTCTTAT CCTGATGCCAGGGATAAAAATTCAGCCTTTAATCCAATGGCAAGTGATCC TAACAACTCTTGGACATCATCAGCTCCCACTGTGGAAGGAGAAAATGACA CAATGTCGAATGCCCAGAGAAGCACGCTTAAGTGGGAGAAAGAGGAGGC TCTGGGTGAAATGGCAACTGTTGCCCCAGTTCTCTACACCAATATTAATTT CCCCAACTTAAAGGAAGAATTCCCTGATTGGACTACTAGAGTGAAGCAA ATTGCCAAATTGTGGAGAAAAGCAAGCTCACAAGAAAGAGCACCATATG TGCAAAAAGCCAGAGATAACAGAGCTGCTTTACGCATTAATAAAGTACA GATGTCAAATGATTCCATGAAAAGGCAGCAACAGCAAGATAGCATTGAT CCCAGCTCTCGTATTGATTCGGAGCTTTTTAAAGATCCTTTAAAGCAAAG AGAATCAGAACATGAACAGGAATGGAAATTTAGACAGCAAATGCGTCAG AAAAGTAAGCAGCAAGCTAAAATTGAAGCCACACAGAAACTTGAACAGG TGAAAAATGAGCAGCAGCAGCAGCAACAACAGCAATTTGTTCTCAGCA TCTTCTGGTGCAGTCTGGTTCAGATACACCAAGTAGTGGGATACAGAGTC CCTTGACACCTCAGCCTGGCAATGGAAATATGTCTCCTGCACAGTCATTC CATAAAGAACTGTTTACAAAACAGCCACCCAGTACCCCTACGTCTACATC TTCAGATGATGTGTTTGTAAAGCCACAAGCTCCACCTCCTCCTCCAGCCCC ATCCCGGATTCCCATCCAGGATAGTCTTTCTCAGGCTCAGACTTCTCAGCC ACCCTCACCGCAAGTGTTTTCACCTGGGTCCTCTAACTCACGACCACCATC TCCAATGGATCCATATGCAAAAATGGTTGGTACCCCTCGACCACCTCCTG TGGGCCATAGTTTTTCCAGAAGAAATTCTGCTGCACCAGTGGAAAACTGT ACACCTTTATCATCGGTATCTAGGCCCCTTCAAATGAATGAGACAACAGC AAATAGGCCATCCCCTGTCAGAGATTTATGTTCTTCTTCCACGACAAATA ATGACCCCTATGCAAAACCTCCAGACACACCTAGGCCTGTGATGACAGAT CAATTTCCCAAATCCTTGGGCCTATCCCGGTCTCCTGTAGTTTCAGAACAA ACTGCAAAAGGCCCTATAGCAGCTGGAACCAGTGATCACTTTACTAAACC ATCTCCTAGGGCAGATGTGTTTCAAAGACAAAGGATACCTGACTCATATG CACGACCCTTGTTGACACCTGCACCTCTTGATAGTGGTCCTGGACCTTTTA AGACTCCAATGCAACCTCCTCCATCCTCTCAGGATCCTTATGGATCAGTGT CACAGGCATCAAGGCGATTGTCTGTTGACCCTTATGAAAGGCCTGCTTTG ACACCAAGACCTATAGATAATTTTTCTCATAATCAGTCAAATGATCCATA TAGTCAGCCTCCCCTTACCCCACATCCAGCAGTGAATGAATCTTTTGCCCA TCCTTCAAGGGCTTTTTCCCAGCCTGGAACCATATCAAGGCCAACATCTC AGGACCCATACTCCCAACCCCCAGGAACTCCACGACCTGTTGTAGATTCT TATTCCCAATCTTCAGGAACAGCTAGGTCCAATACAGACCCTTACTCTCA ACCTCCTGGAACTCCCCGGCCTACTACTGTTGACCCATATAGTCAGCAGC CCCAAACCCCAAGACCATCTACACAAACTGACTTGTTTGTTACACCTGTA ACAAATCAGAGGCATTCTGATCCATATGCTCATCCTCCTGGAACACCAAG ACCTGGAATTTCTGTCCCTTACTCTCAGCCACCAGCAACACCAAGGCCAA GGATTTCAGAGGGTTTTACTAGGTCCTCAATGACAAGACCAGTCCTCATG CCAAATCAGGATCCTTTCCTGCAAGCAGCACAAAACCGAGGACCAGCTTT ACCTGGCCCGTTGGTAAGGCCACCTGATACATGTTCCCAGACACCTAGGC CCCCTGGACCTGGTCTTTCAGACACATTTAGCCGTGTTTCCCCATCTGCTG CCCGTGATCCCTATGATCAGTCTCCAATGACTCCAAGATCTCAGTCTGACT CTTTTGGAACAAGTCAAACTGCCCATGATGTTGCTGATCAGCCAAGGCCT GGATCAGAGGGGAGCTTCTGTGCATCTTCAAACTCTCCAATGCACTCCCA AGGCCAGCAGTTCTCTGGTGTCTCCCAACTTCCTGGACCTGTGCCAACTTC AGGAGTAACTGATACACAGAATACTGTAAATATGGCCCAAGCAGATACA GAGAAATTGAGACAGCGGCAGAAGTTACGTGAAATCATTCTCCAGCAGC | |

TABLE B-continued

| Gene Fusion | Chimera Sequence | SEQ ID NO. |
|---|---|---|
| | AACAGCAGAAGAAGATTGCAGGTCGACAGGAGAAGGGGTCACAGGACTC ACCCGCAGTGCCTCATCCAGGGCCTCTTCAACACTGGCAACCAGAGAATG TTAACCAGGCTTTCACCAGACCCCCACCTCCCTATCCTGGGAACATTAGG TCTCCTGTTGCCCCTCCTTTAGGACCTAGATATGCTGTTTTCCCAAAAGAT CAGCGTGGACCCTATCCTCCTGATGTTGCTAGTATGGGGATGAGACCTCA TGGATTTAGATTTGGATTTCCAGGAGGTAGTCATGGTACCATGCCGAGTC AAGAGCGCTTCCTTGTGCCTCCTCAGCAAATACAGGGATCTGGAGTTTCT CCACAGCTAAGAAGATCAGTATCTGTAGATATGCCTAGGCCTTTAAATAA CTCACAAATGAATAATCCAGTTGGACTTCCTCAGCATTTTTCACCACAGA GCTTGCCAGTTCAGCAGCACAACATACTGGGCAAGCATATATTGAACTG AGACATAGGGCTCCTGACGGAAGGCAACGGCTGCCTTTCAGTGCTCCACC TGGCAGCGTTGTAGAGGCATCTTCTAATCTGAGACATGGAAACTTCATTC CCCGGCCAGACTTTCCGGGCCCTAGACACACAGACCCCATGCGACGACCT CCCCAGGGTCTACCTAATCAGCTACCTGTGCACCCAGATTTGGAACAAGT GCCACCATCTCAACAAGAGCAAGGTCATTCTGTCCATTCATCTTCTATGGT CATGAGGACTCTGAACCATCCACTAGGTGGTGAATTTTCAGAAGCTCCTT TGTCAACATCTGTACCGTCTGAAACAACGTCTGATAATTTACAGATAACC ACCCAGCCTTCTGATGGTCTAGAGGAAAAACTTGATTCTGATGACCCTTC TGTGAAGGAACTGGATGTTAAAGACCTTGAGGGGGTTGAAGTCAAAGAC TTAGATGATGAAGATCTTGAAAACTTAAATTTAGATACAGAGGATGGCAA GGTAGTTGAATTGGATACTTTAGATAATTTGGAAACTAATGATCCCAACC TGGATGACCTCTTAAGGTCAGGAGAGTTTGATATCATTGCATATACAGAT CCAGAACTTGACATGGGAGATAAGAAAAGCATGTTTAATGAGGAACTAG ACCTTCCAATTGATGATAAGTTAGATAATCAGTGTGTATCTGTTGAACCA AAAAAAAAGGAACAAGAAAACAAAACTCTGGTTCTCTCTGATAAACATT CACCACAGAAAAAATCCACTGTTACCAATGAGGTAAAAACGGAAGTACT GTCTCCAAATTCTAAGGTGGAATCCAAATGTGAAACTGAAAAAAATGAT GAGAATAAAGATAATGTTGACACTCCTTGCTCACAGGCTTCTGCTCACTC AGACCTAAATGATGGAGAAAAGACTTCTTTGCATCCTTGTGATCCAGATC TATTTGAGAAAAGAACCAATCGAGAAACTGCTGGCCCCAGTGCAAATGT CATTCAGGCATCCACTCAACTACCTGCTCAAGATGTAATAAACTCTTGTG GCATAACTGGATCAACTCCAGTTCTCTCAAGTTTACTTGCTAATGAGAAA TCTGATAATTCAGACATTAGGCCATCGGGGTCTCCACCACCACCAACTCT GCCGGCCTCCCCATCCAATCATGTGTCAAGTTTGCCTCCTTTCATAGCACC GCCTGGCCGTGTTTTGGATAATGCCATGAATTCTAATGTGACAGTAGTCT CTAGGGTAAACCATGTTTTTTCTCAGGGTGTGCAGGTAAACCCAGGGCTC ATTCCAGGTCAATCAACAGTTAACCACAGTCTGGGGACAGGAAAACCTG CAACTCAAACTGGGCCTCAAACAAGTCAGTCTGGTACCAGTAGCATGTCT GGACCCCAACAGCTAATGATTCCTCAAACATTAGCACAGCAGAATAGAG AGAGGCCCCTTCTTCTAGAAGAACAGCCTCTACTTCTACAGGATCTTTTG GATCAAGAAAGGCAAGAACAGCAGCAGCAAAGACAGATGCAAGCCATG ATTCGTCAGCGATCAGAACCGTTCTTCCCTAATATTGATTTTGATGCAATT ACAGATCCTATAATGAAAGCCAAATGGTGGCCCTTAAAGGTATAAATA AAGTGATGGCACAAAACAATCTGGGCATGCCACCAATGGTGATGAGCAG GTTCCCTTTTATGGGCCAGGTGGTAACTGGAACACAGAACAGTGAAGGAC AGAACCTTGGACCACAGGCCATTCCTCAGGATGGCAGTATAACACATCAG ATTTCTAGGCCTAATCCTCCAAATTTTGGTTCCAGGCTTTGTCAATGATTCA CAGCGTAAGCAGTATGAAGAGTGGCTCCAGGAGACCCAACAGCTGCTTC AAATGCAGCAGAAGTATCTTGAAGAACAAATTGGTGCTCACAGAAAATC TAAGAAGGCCCTTTCAGCTAAACAACGTACTGCCAAGAAAGCTGGGCGT GAATTTCCAGAGGAAGATGCAGAACAACTCAAGCATGTTACTGAACAGC AAAGCATGGTTCAGAAACAGCTAGAACAGATTCGTAAACAACAGAAAGA ACATGCTGAATTGATTGAAGATTATCGGATCAAACAGCAGCAGCAATGTG CAATGGCCCCACCTACCATGATGCCCAGTGTCCAGCCCCAGCCACCCCTA ATTCCAGGTGCCACTCCACCCACCATGAGCCAACCCACCTTTCCCATGGT GCCACAGCAGCTTCAGCACCAGCAGCACACAACAGTTATTTCTGGCCATA CTAGCCCTGTTAGAATGCCCAGTTTACCTGGATGCAACCCAACAGTGCT CCTGCCCACCTGCCCCTCAATCCTCCTAGAATTCAGCCCCCAATTGCCCAG TTACCAATAAAAACTTGTACACCAGCCCCAGGGACAGTCTCAAATGCAAA TCCACAGAGTGGACCACCACCTCGGGTAGAATTTGATGACAACAATCCCT TTAGTGAAAGTTTTCAAGAACGGGAACGTAAGGAACGTTTACGAGAACA GCAAGAGACAACGGATCCAACTCATGCAGGAGGTAGATAGCAAAGA GCTTTGCAGCAGAGGATGGAAATGGAGCAGCATGGTATGGTGGGCTCTG AGATAAGTAGTAGTAGGACATCTGTGTCCCAGATTCCCTTCTACAGTTCC GACTTACCTTGTGATTTTATGCAACCTCTAGGACCCCTTCAGCAGTCTCCA CAACACCAACAGCAAATGGGGCAGGTTTTACAGCAGCAGAATATACAAC AAGGATCAATTAATTCACCCTCCACCCAAACTTTCATGCAGACTAATGAG CGAAGGCAGGTAGGCCCTCCTTCATTTGTTCCTGATTCACCATCAATCCCT GTTGGAAGCCCAAATTTTTCTTCTGTGAAGCAGGGACATGGAAATCTTTC TGGGACCAGCTTCCAGCAGTCCCCAGTGAGGCCTTCTTTTACACCTGCTTT ACCAGCAGCACCTCCAGTAGCTAATAGCAGTCTCCCATGTGGCCAAGATT CTACTATAACCCATGGACACAGTTATCCGGGATCAACCCAATCGCTCATT CAGTTGTATTCTGATATAATCCCAGAGGAAAAAGGGAAAAGAAAAGAA CAAGAAGAAGAAAGAGATGATGATGCAGAATCCACCAAGGCTCCATC AACTCCCCATTCAGATATAACTGCCCCACCGACTCCAGGCATCTCAGAAA CTACCTCTACTCCTGCAGTGAGCACACCCAGTGAGCTTCCTCAACAAGCC GACCAAGAGTCGGTGGAACCAGTCGGCCCATCCACTCCCAATATGGCAG | |

TABLE B-continued

| Gene Fusion | Chimera Sequence | SEQ ID NO. |
|---|---|---|
| | CAGGCCAGCTATGTACAGAATTAGAGAACAAACTGCCCAATAGTGATTTC<br>TCACAAGCAACTCCAAATCAACAGACGTATGCAAATTCAGAAGTAGACA<br>AGCTCTCCATGGAAACCCTGCCAAAACAGAAGAGATAAAACTGGAAAA<br>GGCTGAGACAGAGTCCTGCCCAGGCCAAGAGGAGCCTAAATTGGAGGAA<br>CAGAATGGTAGTAAGGTAGAAGGAAACGCTGTAGCCTGTCCTGTCTCCTC<br>AGCACAGAGTCCTCCCCATTCTGCTGGGGCCCCTGCTGCCAAAGGAGACT<br>CAGGGAATGAACTTCTGAAACACTTGTTGAAAAATAAAAAGTCATCTTCT<br>CTTTTGAATCAAAAACCTGAGGGCAGTATTTGTTCAGAAGATGACTGTAC<br>AAAGGATAATAAACTAGTTGAGAAGCAGAACCCAGCTGAAGGACTGCAA<br>ACTTTGGGGGCTCAAATGCAAGGTGGTTTTGGATGTGGCAACCAGTTGCC<br>AAAAACAGATGGAGGAAGTGAAACCAAGAAACAGCGAAGCAAACGGAC<br>TCAGAGGACGGGTGAGAAAGCAGCACCTCGCTCAAAGAAAAGGAAAAA<br>GGACGAAGAGGAGAAACAAGCTATGTACTCTAGCACTGACACGTTTACC<br>CACTTGAAACAGCAGAATAATTTAAGTAATCCTCCAACACCCCCTGCCTC<br>TCTTCCTCCTACACCACCTCCTATGCTTGTCAGAAGATGGCCAATGGTTT<br>TGCAACAACTGAAGAACTTGCTGGAAAAGCCGGAGTGTTAGTGAGCCAT<br>GAAGTTACCAAAACTCTAGGACCTAAACCATTTCAGCTGCCCTTCAGACC<br>CCAGGACGACTTGTTGGCCCGAGCTCTTGCTCAGGGCCCCAAGACAGTTG<br>ATGTGCCAGCCTCCCTCCCAACACCACCTCATAACAATCAGGAAGAATTA<br>AGGATACAGGATCACTGTGGTGATCGAGATACTCCTGACAGTTTTGTTCC<br>CTCATCCTCTCCTGAGAGTGTGGTTGGGGTAGAAGTGAGCAGGTATCCAG<br>ATCTGTCATTGGTCAAGGAGGAGCCTCCAGAACCGGTGCCGTCCCCCATC<br>ATTCCAATTCTTCCTAGCACTGCTGGGAAAAGTTCAGAATCAAGAAGGAA<br>TGACATCAAAACTGAGCCAGGCACTTTATATTTTGCGTCACCTTTTGGTCC<br>TTCCCCAAATGGTCCCAGATCAGGTCTTATATCTGTAGCAATTACTCTGCA<br>TCCTACAGCTGCTGAGAACATTAGCAGTGTTGTGGCTGCATTTTCCGACCT<br>TCTTCACGTCCGAATCCCTAACAGCTATGAGGTTAGCAGTGCTCCAGATG<br>TCCCATCCATGGGTTTGGTCAGTAGCCACAGAATCAACCCGGGTTTGGAG<br>TATCGACAGCATTTACTTCTCCGTGGGCCTCCGCCAGGATCTGCAAACCC<br>TCCCAGATTAGTGAGCTCTTACCGGCTGAAGCAGCCTAATGTACCATTTC<br>CTCCAACAAGCAATGGTCTTTCTGGATATAAGGATTCTAGTCATGGTATT<br>GCAGAAAGCGCAGCACTCAGACCACAGTGGTGTTGTCATTGTAAAGTGGT<br>TATTCTTGGAAGTGGTGTGCGGAAATCTTTCAAAGATCTGACCCTTTTGA<br>ACAAGGATTCCCGAGAAAGCACCAAGAGGGTAGAGAAGGACATTGTCTT<br>CTGTAGTAATAACTGCTTTATTCTTTATTCATCAACTGCACAAGCGAAAA<br>ACTCAGAAAACAAGGAATCCATTCCTTCATTGCCACAATCACCTATGAGA<br>GAAACGCCTTCCAAAGCATTTCATCAGTACAGCAACAACATCTCCACTTT<br>GGATGTGCACTGTCTCCCCCAGCTCCCAGAGAAAGCTTCTCCCCCTGCCT<br>CACCCACCCATCGCCTTCCCTCCTGCTTTTGAAGCAGCCCAAGTCGAGGCC<br>AAGCCAGATGAGCTGAAGGTGACAGTCAAGCTGAAGCCTCGGCTAAGAG<br>CTGTCCATGGTGGGTTTGAAGATTGCAGGCCGCTCAATAAAAAATGGAGA<br>GGAATGAAATGGAAGAAGTGGAGCATTCATATTGTAATCCCTAAGGGGA<br>CATTTAAACCACCTTGTGAGGATGAAATAGATGAATTTCTAAAGAAATTG<br>GGCACTTCCCTTAAACCTGATCCTGTGCCCAAAGACTATCGGAAATGTTG<br>CTTTTGTCATGAAGAAGGTGATGGATTGACAGATGGACCAGCAAGGCTAC<br>TCAACCTTGACTTGGATCTGTGGGTCCACTTGAACTGCGCTCTGTGGTCCA<br>CGGAGGTCTATGAGACTCAGGCTGGTGCCTTAATAAATGTGGAGCTAGCT<br>CTGAGGAGAGGCCTACAAATGAAATGTGTCTTCTGTCACAAGACGGGTGC<br>CACTAGTGGATGCCACAGATTTCGATGCACCAACATTTATCACTTCACTT<br>GCGCCATTAAAGCACAATGCATGTTTTTTAAGGACAAAACTATGCTTTGC<br>CCCATGCACAAACCAAAGGGAATTCATGAGCAAGAATTAAGTTACTTTGC<br>AGTCTTCAGGAGGGTCTATGTTCAGCGTGATGAGGTGCGACAGATTGCTA<br>GCATCGTGCAACGAGGAGAACGGGACCATACCTTTCGCGTGGGTAGCCTC<br>ATCTTCCACACAATTGGTCAGCTGCTTCCACAGCAGATGCAAGCATTCCA<br>TTCTCCTAAAGCACTCTTCCCTGTGGGCTATGAAGCCAGCCGGCTGTACT<br>GGAGCACTCGCTATGCCAATAGGCGCTGCCGCTACCTGTGCTCCATTGAG<br>GAGAAGGATGGGCGCCCAGTGTTTGTCATCAGGATTGTGGAACAAGGCC<br>ATGAAGACCTGGTTCTAAGTGACATCTCACCTAAAGGTGTCTGGGATAAG<br>ATTTTGGAGCCTGTGTGGCATGTGTGAGAAAAAAGTCTGAAATGCTCCAGCT<br>TTTCCCAGCGTATTTAAAAGGAGAGGATCTGTTTGGCCTGACCGTCTCTG<br>CAGTGGCACGCATAGCGGAATCACTTCCTGGGGTTGAGGCATGTGAAAAT<br>TATACCTTCCGATACGGCCGAAATCCTCTCATGGAACTTCCTCTTGCCGTT<br>AACCCCACAGGTTGTGCCCGTTCTGAACCTAAAATGAGTGCCCATGTCAA<br>GAGGTTTGTGTTAAGGCCTCACACCTTAAACAGCACCAGCACCTCAAAGT<br>CATTTCAGAGCACAGTCACTGGAGAACTGAACGCACCTTATAGTAAACAG<br>TTTGTTCACTCCAAGTCATCGCAGTACCGGAAGATGAAAACTGAATGGAA<br>ATCCAATGTGTATCTGGCACGGTCTCGGATTCAGGGGCTGGGCCTGTATG<br>CTGCTCGAGACATTGAGAAACACACCATGGTCATTGAGTACATCGGGACT<br>ATCATTCGAAACGAAGTAGCCAACAGGAAAGAGAAGCTTTATGAGTCTC<br>AGAACCGTGGTGTGTACATGTTCCGCATGGATAACGACCATGTGATTGAC<br>GCGACGCTCACAGGAGGGCCCGCAAGGTATATCAACCATTCGTGTGCACC<br>TAATTGTGTGGCTGAAGTGGTGACTTTTGAGAGAGGACACAAAATTATCA<br>TCAGCTCCAGTCGGAGAATCCAGAAAGGAGAAGAGCTCTGCTATGACTA<br>TAAGTTTGACTTTGAAGATGACCAGCACAAGATTCCGTGTCACTGTGGAG<br>CTGTGAACTGCCGGAAGTGGATGAACTGA | |

TABLE B-continued

| Gene Fusion | Chimera Sequence | SEQ ID NO. |
|---|---|---|
| CLTB-> CDHR2 | ATGGCTGATGACTTTGGCTTCTTCTCGTCGTCGGAGAGCGGTGCCCCGGA GGCGGCGGAGGAGGACCCGGCGGCCGCCTTCCTGGCCCAGCAGGAGAGC GAGATTGCAGGCATAGAGAACGACGAGGGCTTCGGGGCACCTGCCGGCA GCCATGCGGCCCCCGCGCAGCCGGGCCCCACGAGTGGGGCTGGTTCTGA GGACATGGGGACCACAGTCAATGGAGATGTGTTTCAGGTGCCCAGGCCTT CTGGTTGGTAGCGGAAGACCAGGACAATGACCCTCTGACCTATGGGATG AGCGGCCCCAATGCCTACTTCTTCGCTGTCACTCCGAAAACTGGGGAAGT GAAGCTGGCCAGCGCTCTGGACTACGAGACACTCTACACATTCAAAGTCA CCATCTCCGTGAGCGACCCCTACATCCAGGTGCAGAGGGAGATGCTGGTG ATTGTGGAAGATAGAAACGACAACGCACCCGTTTTCCAGAACACCGCTTT CTCCACCAGCATCAACGAGACCCTGCCCGTGGGCAGTGTGGTGTTCTCCG TGCTGGCCGTGGATAAAGACATGGGGTCTGCAGGCATGGTCGTGTACTCC ATAGAGAAGGTCATCCCTAGCACTGGGGACAGCGAGCATCTCTTCCGGAT CCTGGCCAATGGCTCCATAGTCCTCAATGGCAGCCTCAGCTACAACAACA GAGCGCTTTCTACCAGCTGGAGCTGAAGGCCTGTGACTTGGGCGGCATG TACCACAACACCTTCACCATCCAGTGCTCCCTGCCTGTCTTCCTGTCCATC TCCGTGGTGGACCAGCCTGACCTTGACCCCCAGTTTGTCAGGGAGTTTTA CTCGGCCTCTGTGGCTGAGGATGCAGCCAAGGGAACCTCGGTGCTGACGG TGGAGGCTGTGGATGGCGACAAAGGCATCAATGACCCTGTGATCTACAG CATCTCCTACTCCACGCGGCCCGGCTGGTTTGACATCGGGGCAGATGGGG TGATCAGGGTCAACGGCTCCCTGGACCGTGAGCAGCTGCTGGAGGCGGA TGAGGAGGTGCAGCTGCAGGTCACGGCCACCGAGACACACCTCAACATC TACGGGCAGGAGGCCAAGGTGAGCATCTGGGTGACAGTGAGAGTGATGG ACGTCAATGACCACAAACCTGAGTTTTACAACTGCAGCCTCCCAGCCTGC ACCTTCACCCCCGAAGAGGCCAAGTGAACTTCACTGGCTACGTGGACGA GCATGCCTCCCCCGCATCCCCATCGATGACCTCACCATGGTGGTCTACG ACCCGGACAAGGGCAGCAATGGCACCTTCCTGTTGTCGCTGGGGGGCCCC GATGCAGAAGCCTTCAGCGTCTCCCCGGAGCGGGCAGTGGGCTCAGCCTC CGTTCAGGTGCTGGTGAGAGTATCCGCGCTGGTGGACTACGAGAGGCAG ACGGCGATGGCGGTGCAGGTTGTGGCCACAGACTCCGTCAGCCAGAACTT CTCCGTCGCCATGGTGACCATCCACCTTAGAGACATTAATGACCACAGGC CCACGTTTCCCCAGAGCTTGTACGTCCTCACGGTGCCAGAGCACAGCGCC ACCGGCTCTGTGGTCACCGACAGCATCCACGCCACGGACCCAGACACGG GCGCGTGGGGCCAAATTACCTACAGCCTGCTCCCAGGAAATGGGGCAGA CCTCTTCCAAGTGGATCCCGTCTCAGGGACGGTGACGGTGAGGAACGGTG AGCTGCTGGACCGGGAGAGCCAGGCCGTGTACTACCTGACGCTGCAGGC CACAGACGGCGGGAACCTGTCCTCCTCCACCACACTGCAGATCCACCTGC TGGACATCAACGACAATGCACCCGTGGTTAGCGGCTCCTACAACATCTTC GTCCAGGAGGAGGAGGGCAATGTCTCCGTGACCATCCAGGCCCACGACA ATGATGAGCCGGGCACCAACAACAGCCGTCTGCTCTTCAACCTGCTGCCT GGCCCCTACAGCCACAACTTCTCCTTGGACCCTGACACAGGGCCTCCAG AAACCTGGGGCCCCTGGACAGAGAGGCCATCGACCCCGCCCTGGAGGGC CGCATTGTGCTGACAGTGCTTGTGTCTGACTGCGGCGAGCCTGTCCTCGG CACCAAAGTCAATGTCACCATCACTGTGGAGGACATCAATGATAACCTGC CCATCTTCAATCAGTCCAGCTACAACTTTACGGTGAAGGAGGAGGATCCA GGGAGTGCTAGTGGGCGTGGTGAAGGCCTGGGACGCGGACCAGACGGAAG CCAACAACCGCATCAGCTTCAGCCTGTCGGGGAGTGGTGCCAACTACTTC ATGATCCGAGGCTTGGTGCTGGGGGCTGGGTGGGCTGAGGGCTACCTCCG GCTGCCCCGGACGTGAGCCTGGATTACGAGACACAGCCCGTCTTCAACT TGACAGTGAGTGCTGAGAACCCAGACCCCCAGGGGGGTGAGACCATAGT AGACGTCTGCGTGAATGTGAAAGACGTGAACGACAATCCCCCACCCCTG GATGTAGCCTCACTCCGGGGCATCCGTGTGGCTGAGAATGGCTCACAGCA CGGCCAGGTGGCTGTGGTGGTTGCCTCGGATGTGGACACCAGTGCCCAGC TGGAGATACAGCTTGTGAACATTCTCTGCACCAAGGCCGGGGTCGATGTG GGCAGCCTATGCTGGGGCTGGTTCTCAGTGGCGGCCAACGGCTCTGTGTA CATCAACCAGAGCAAAGCCATCGACTACGAGGCTGTGACCTGGTCACG CTGGTTGTGCGGGCCTGTGACCTAGCCACGGACCCCGGCTTCCAGGCCTA CAGCAACAATGGAAGCCTCCTCATTACCATTGAGGACGTGAATGACAATG CACCCTATTTTCTGCCTGAGAATAAGACTTTTGTGATCATCCCTGAACTCG TGCTGCCCAACCGGGAGGTGGCTTCTGTCCGGGCCAGAGACGATGATTCA GGGAACAATGGCGTCATCCTGTTCTCCATCCTCCGAGTAGACTTCATCTCT AAGGACGGGGCCACCATCCCTTTCCAGGGTGTCTTCTCGATCTTCACCTCC TCCGAGGCCGACGTGTTCGCTGGGAGCATTCAGCCGGTGACCAGCCTCGA CTCCACTCTCCAAGGCACCTACCAAGTGACAGTCCAGGCCAGGGACAGA CCTTCCTTGGGTCCTTTCCTGGAAGCCACCACCACCCTGAATCTCTTCACC GTGGACCAGAGTTACCGCTCGCGGCTGCAGTTCTCCACACCGAAGGAGG AGGTGGGCGCCAACAGACAGGCGATTAATGCGGCTCTTACCCAGGCAAC CAGGACTACAGTATACATTGTGGACATTCAGGACATAGATTCTGCAGCTC GGGCCCGACCTCACTCCTACCTCGATGCCTACTTTGTCTTCCCCAATGGGT CAGCCCTGACCCTTGATGAGCTGAGTGTGATGATCCGGAATGATCAGGAC TCGCTGACGCAGCTGCTGCAGCTGGGGCTGGTGGTGCTGGGCTCCCAGGA GAGCCAGGAGTCAGACCTGTCGAAACAGCTCATCAGTGTCATCATAGGAT TGGGAGTGGCTTTGCTGCTGGTCCTTGTGATCATGACCATGGCCTTCGTGT GTGTGCGGAAGAGCTACAACCGGAAGCTTCAAGCTATGAAGGCTGCCAA GGAGGCCAGGAAGACAGCAGCAGGGGTGATGCCCTCAGCCCCTGCCATC CCAGGGACTAACATGTACAACACTGAGCGAGCCAACCCCATGCTGAACC | SEQ ID NO: 26 |

TABLE B-continued

| Gene Fusion | Chimera Sequence | SEQ ID NO. |
|---|---|---|
| | TCCCCAACAAAGACCTGGGCTTGGAGTACCTCTCTCCCTCCAATGACCTG<br>GACTCTGTCAGCGTCAACTCCCTGGACGACAACTCTGTGGATGTGGACAA<br>GAACAGTCAGGAAATCAAGGAGCACAGGCCACCACACACACCACCAGAG<br>CCAGATCCAGAGCCCCTGAGCGTGGTCCTGTTAGGACGGCAGGCAGGCG<br>CAAGTGGACAGCTGGAGGGGCCATCCTACACCAACGCTGGCCTGGACAC<br>CACGGACCTGTGA | |
| PDE4D-><br>ITGA1 | ATGATGCACGTGAATAATTTTCCCTTTAGAAGGCATTCCTGGATATGTTTT<br>GATGTGGACAATGGCACATCTGCGGGACGGAGTCCCTTGGATCCCATGAC<br>CAGCCCAGGATCCGGGCTAATTCTCCAAGCAAATTTTGTCCACAGTCAAC<br>GACGGGAGTCCTTCCTGTATCGATCCGACAGCGATTATGACCTCTCTCCA<br>AAGTCTATGTCCCGGAACTCCTCCATTGCCAGTGATATACACGGAGATGA<br>CTTGATTGTGACTCCATTTGCTCAGGTCTTGGCCAGTCTGCGAACTGTACG<br>AAACAACTTTGCTGCATTAACTAATTTGCAAGATCGAGCACCTAGCAAA<br>GATCACCCATGTGCAACCAACCATCCATCAACAAAGCCACCATAACAGA<br>GGAGGCCTACCAGAAACTGGCCAGCGAGACCCTGGAGGAGCTGGACTGG<br>TGTCTGGACCAGCTAGAGACCCTACAGACCAGGCACTCCGTCAGTGAGAT<br>GGCCTCCAACAAGTTTAAAAGGATGCTTAATCGGGAGCTCACCCATCTCT<br>CTGAAATGAGTCGGTCTGGAAATCAAGTGTCAGAGTTTATATCAAACACA<br>TTCTTAGATAAGCAACATGAAGTGGAAATTCCTTCTCCAACTCAGAAGGA<br>AAAGGAGAAAAGAAAAGACCAATGTCTCAGATCAGTGGAGTCAAGAA<br>ATTGATGCACAGCTCTAGTCTGACTAATTCAAGTATCCCAAGGTTTGGAG<br>TTAAAACTGAACAAGAAGATGTCCTTGCCAAGGAACTAGAAGATGTGAA<br>CAAATGGGTCTTCATGTTTTCAGAATAGCAGAGTTGTCTGGTAACCGGC<br>CCTTGACTGTTATCATGCACACCATTTTTCAGGAACGGGATTTATTAAAA<br>ACATTTAAAATTCCAGTAGATACTTTAATTACATATCTTATGACTCTCGAA<br>GACCATTACCATGCTGATGTGGCCTATCACAACAATATCCATGCTGCAGA<br>TGTTGTCCAGTCTACTCATGTGCTATTATCTACACCTGCTTTGGAGGCTGT<br>GTTTACAGATTTGGAGATTCTTGCAGCAATTTTTGCCAGTGCAATACATG<br>ATGTAGATCATCCTGGTGTGTCCAATCAATTTCTGATCAATACAAGACAA<br>GCATGACTTTCAGGACTCTGTGAGAATAACGTTGGACTTTAATCTTACCG<br>ATCCAGAAAATGGGCCTGTTCTTGATGATTCTCTACCAAACTCAGTACAT<br>GAATATATTCCCTTTGCCAAAGATTGTGGAAATAAGGAAAAATGTATCTC<br>AGACCTCAGCCTGCATGTCGCCACCACTGAAAAGGACCTGCTGATTGTCC<br>GATCCCAGAATGATAAGTTCAACGTTAGCCTCACAGTCAAAAATACAAA<br>GGACAGTGCCTATAACACCAGGACAATAGTGCATTATTCTCCAAATCTAG<br>TTTTTTCAGGAATTGAGGCTATCCAAAAAGACAGTTGTGAATCTAATCAT<br>AATATCACATGTAAAGTTGGATATCCCTTCCTGAGAAGAGGAGAGATGGT<br>AACTTTCAAATATTGTTTCAGTTTAACACATCCTATCTCATGGAAAATGT<br>GACCATTTATTTAAGTGCAACAAGTGACAGCGAAGAACCTCCTGAAACCC<br>TTTCTGATAATGTAGTAAACATTTCTATCCCGGTAAAATATGAAGTTGGA<br>CTACAGTTTTACAGCTCTGCAAGTGAATACCACATTTCAATTGCTGCCAAT<br>GAGACAGTCCCTGAAGTTATTAATTCTACTGAGGACATTGGAAATGAAAT<br>TAATATCTTCTACTTGATTAGAAAAAGTGGATCTTTTCCAATGCCAGAGCT<br>TAAGCTGTCAATTTCATTCCCCAATATGACATCAAATGGTTACCCTGTGCT<br>GTACCCAACTGGATTGTCATCTTCTGAGAATGCAAACTGCAGACCCCATA<br>TCTTTGAGGATCCTTTCAGTATCAACTCTGGAAAGAAAATGACTACATCA<br>ACTGACCATCTCAAACGAGGCACAATTCTGGACTGCAATACATGTAAATT<br>TGCTACCATCACATGTAATCTCACTTCTTCTGACATCAGCCAAGTCAATGT<br>TTCGCTTATCTTGTGGAAACCAACTTTTATAAAATCATATTTTTCCAGCTT<br>AAATCTTACTATAAGGGGAGAACTTCGGAGTGAAAATGCATCTCTGGTTT<br>TAAGTAGCAGCAATCAAAAAAGAGAGCTTGCTATTCAAATATCCAAAGA<br>TGGGCTACCGGGCAGAGTGCCATTATGGGTCATCCTGCTGAGTGCTTTTG<br>CCGGATTGTTGCTGTTAATGCTGCTCATTTTAGCACTGTGGAAGATTGGAT<br>TCTTCAAAAGACCACTGAAAAGAAAATGGAGAAATGA | SEQ ID NO: 27 |
| DIP2B-><br>LINC00330 | ATGGCGGAACGAGGCCTGGAGCCGTCGCCGGCCGCGGTGGCGGCGCTGC<br>CGCCTGAAGTGCGGGCGCAGCTGGCGGAGCTGGAGCTGGAGCTCTCGGA<br>GGGGGACATCACCCAGAAGGGCTATGAAAAGAAAAGGTCCAAACTCCTA<br>TCTCCTTACAGCCCGCAGACACAAGAAACTGATTCAGCAGTACAGAAAG<br>AACTTAGAAACCAGACACCTGCTCCATCTGCAGCTCAAACTTCTGCTCCC<br>TCTAAGTACCACCGAACTCGATCTGGGGGAGCCAGGGATGAACGATATC<br>GATCAGAGTCTTGCTCTGTCGCCCAGGCTGGAGTGCAGTGGTGCGACCTT<br>GGCTCACTGGTTTGGGGCATGTTCCTGGGTGTGTCTGTGAGGAGCAAGAA<br>AGCCAGTTCAAGTCCCAAAACCTCAAAAGTAGGGAAGCCGACAGGGCAG<br>CCTTAAGTCTGTGGCTGAAGGCCTGAGAGACCCTGGCAAATCACTGATAT<br>AAGTCCAAAAGCTGAAGAACTTGGAATCTGATGTTGGAATCTGATCTTGG<br>CCCATCCTTGAAGAATCTGGGGGTAATAAATACCCTGAACATTGATGAAC<br>CCAAAGGGAAGCCAGAAGGTCAGATGTCAGCTGTCGGGAAGAAAGGCTG<br>GATAGGAAATAGGAAAAGCAGGGCAAACAAGGAGCTTCAAGGACTGA<br>AACCCTTAAGAACCACTTGACTCTGTCTCTCACCACCTCCAGCCTTGATGA<br>CACGGTGACATATAGAAGAACTGATGCCCTTTGCTTTGAGCTGCACAAAA<br>ACCTGGCGCTGGACTTGGAGAAGCTGAAAGACAGGACCCGGCAGGAGCC<br>TGAGGAGCTGCAGGCTGCTAGCCTGTAGACCACCGTGCTGTGTTAGCCAC<br>TGCAGCTGGGACCATTCTGACACTCAGAGCCTGGAAATGGCTGCTCCCTC<br>CTGCCTGCTATCCAAGTATCCTGTGGATACTTGGCTTTTCTCTTGTGGGCA<br>ACACTAACCTGAAACTCTTTGGGGAAGGGAATTGAGGAAATGTAGTTCCA | SEQ ID NO: 28 |

TABLE B-continued

| Gene Fusion | Chimera Sequence | SEQ ID NO. |
|---|---|---|
| | AGATTAGCCAATTTAACTCAGCATAAACCCATCACAGGGTTTGACTACAG<br>AGTTATAACGTTATTCTGTAGGCAATGAAAACAGAAGTTTTTGAAAAAGG<br>CATCAATTTGATGAAATTGATATTTTGGGGAAGATTAATCTTCTGCTGAGT<br>AAAAATATAACAGGTTGGAGGAAGATGAAAATGGAGAGAGTAGAGTGTAA<br>TTAAAAGTTTGTTGGAGGCCGGGCACGGGATTACGGCTCACTCCTGTAAT<br>CCCAGCACTTTGGGAGGCTGAGGTGGGCGGATCACCTGAGGTCAGGAGC<br>TTGAGATCATCCCGGCCAACATAGTGAAACCCTGTCTCTAATAAAAATAC<br>GAAAAATTAGCTGGGCATGGTGGCGCACACCTGTAATCTCAGCTACTCGG<br>GAGGCTGAGGCAGGAGAATCCCTTGAACCCAGGAGGCAGAGGTTGCAAT<br>GAGCCAAGATGGTGTGATTGCACTCCAGCCCAGGGGACAATGTGAGACT<br>CTGTCTCAAAAAAAAAAAAAATTTGTTGTAGTAGTCCAGGTGTCCGGGT<br>GTTGTTACCAGGGCACCCATGATGAAATAACTGGGAGAGTCCTTTTTTCT<br>GACTGGTTTTCTTCAGTCCCTTTATCTACAGGCACAACTGCTGAAGAAAC<br>CAGATGGCCTGGGATGGCACCAGAGCTTTTTTACCCTTGACCAGATACTA<br>GAGGGAATTAAGACCCCACAAGTGGGCACGAACTGGAACTGGCGACCCC<br>TAGTTGCCTTCAGATCATTAACACATCATTATAATGCTAAAATTCCCTGCC<br>ATTTTGTGAACATGGGTTGCATGAAGACGTAAGTTTATGAATTGCCTCTG<br>CACACCTAGAGTCCCACCCTGTACAGGCTAACATTCCTCCCTACATGCAC<br>CCCCCCACAAACACACCCTGCCTCCCCCAGTCCTTAGAAACCCTATGCCT<br>GGCCGGGCGCAGTGGCTCACGCCTGTAATCCCAGCACTTTGGGAGGCTGA<br>GGCGGGCGGATCACTAGGTCAGGAGATCGAGACCATCCTGGCTAACACG<br>GTGAAACCCTGTCTTTACTAAAAATC | |
| PQLC1-><br>LINC00330 | ATGGAGGCCGAGGGCCTGGACTGGCTCCTGGTGCCACTGCACCAGCTGGT<br>GTCCTGGGGCGCGGCCGCGGCCATGGTCTTCGGAGGGGTGGTGCCCTACG<br>TCCCGCAGTATCGGGACATTCGCAGGACGCAGAACGCCGACGGCTTCTCC<br>ACCTACGTGCCTGGTGCTGCTGGTGGCCAACATTTTGCGGATACTCTTC<br>TGAGTCTTGCTCTGTCGCCCAGGCTGGAGTGCAGTGGTGCGACCTTGGCT<br>CACTGGTTTGGGGCATGTTCCTGGGTGTGTCTGTGAGGAGCAAGAAAGCC<br>AGTTCAAGTCCCAAAACCTCAAAAGTAGGGAAGCCGACAGGGCAGCCTT<br>AAGTCTGTGGCTGAAGGCCTGAGAGACCCTGGCAAATCACTGATATAAGT<br>CCAAAAGCTGAAGAACTTGGAATCTGATGTTGGAATCTGATCTTGGCCCA<br>TCCTTGAAGAATCTGGGGGTAATAAATACCCTGAACATTGATGAACCCAA<br>AGGGAAGCCAGAAGGTCAGATGTCAGCTGTCGGGAAGAAAGGCTGGATA<br>GGAAATAGGAAAAAGCAGGGCAAACAAGGAGCTTCAAGGACTGAAACC<br>CTTAAGAACCACTTGACTCTGTCTCTCACCACCTCCAGCCTTGATGACACG<br>GTGACATATAGAAGAACTGATGCCCTTTGCTTTGAGCTGCACAAAAACCT<br>GGCGCTGGACTTGAGAAGCTGAAAGACAGGACCCGGCAGGAGCCTGAG<br>GAGCTGCAGGCTGCTAGCCTGTAGACACCGTGCTGTGTTAGCCACTGCA<br>GCTGGGACCATTCTGACACTCAGAGCCTGGAAATGGCTGCTCCCTCCTGC<br>CTGCTATCCAAGTATCCTGTGGATACTTGGCTTTTCTCTTGTGGGCAACAC<br>TAACCTGAAACTCTTTGGGGAAGGGAATTGAGGAAATGTAGTTCCAAGAT<br>TAGCCAATTTAACTCAGCATAAACCCATCACAGGGTTTGACTACAGAGTT<br>ATAACGTTATTCTGTAGGCAATGAAAACAGAAGTTTTTGAAAAAGGCATC<br>AATTTGATGAAATTGATATTTTGGGGAAGATTAATCTTCTGCTGAGTAAA<br>ATATAACAGGTTGGAGGAAGATGAAAATGGAGAGAGTAGAGTGTAATTA<br>AAAGTTTGTTGGAGGCCGGGCACGGGATTACGGCTCACTCCTGTAATCCC<br>AGCACTTTGGGAGGCTGAGGTGGGCGGATCACCTGAGGTCAGGAGCTTG<br>AGATCATCCCGGCCAACATAGTGAAACCCTGTCTCTAATAAAAATACGAA<br>AAATTAGCTGGGCATGGTGGCGCACACCTGTAATCTCAGCTACTCGGGAG<br>GCTGAGGCAGGAGAATCCCTTGAACCCAGGAGGCAGAGGTTGCAATGAG<br>CCAAGATGGTGTGATTGCACTCCAGCCCAGGGGACAATGTGAGACTCTGT<br>CTCAAAAAAAAAAAAAATTTGTTGTAGTAGTCCAGGTGTCCGGGTGTTG<br>TTACCAGGGCACCCATGATGAAATAACTGGGAGAGTCCTTTTTTCTGACT<br>GGTTTTCTTCAGTCCCTTTATCTACAGGCACAACTGCTGAAGAAACCAGA<br>TGGCCTGGGATGGCACCAGAGCTTTTTTACCCTTGACCAGATACTAGAGG<br>GAATTAAGACCCCACAAGTGGGCACGAACTGGAACTGGCGACCCCTAGT<br>TGCCTTCAGATCATTAACACATCATTATAATGCTAAAATTCCCTGCCATTT<br>TGTGAACATGGGTTGCATGAAGACGTAAGTTTATGAATTGCCTCTGCACA<br>CCTAGAGTCCCACCCTGTACAGGCTAACATTCCTCCCTACATGCACCCCCC<br>CCACAAACACACCCTGCCTCCCCCAGTCCTTAGAAACCCTATGCCTGGCC<br>GGGCGCAGTGGCTCACGCCTGTAATCCCAGCACTTTGGGAGGCTGAGGCG<br>GGCGGATCACTAGGTCAGGAGATCGAGACCATCCTGGCTAACACGGTGA<br>AACCCTGTCTTTACTAAAAATC | SEQ ID NO: 29 |
| RABEP1-><br>DNAH9 | ATGGCGCAGCCGGGCCCGGCTTCCCAGCCTGACGTTTCTCTTCAGCAACG<br>GGTAGCAGAATTGGAAAAAATTAATGCAGAATTTTTACGTGCACAACAG<br>CAGCTTGAACAAGAATTTAATCAAAAGAGAGCAAAATTTAAGGAGTTAT<br>ATTTGGCTAAAGAGGAGGATCTGAAGAGGCAAAATGCAGTATTACAAGC<br>TGCACAAGATGATTTGGGACACCTTCGAACCCAGCTGTGGGAAGCTCAAG<br>CAGAGATGGAGAATATTAAGGCGATTGCCACAGTCTCTGAGAACACCAA<br>GCAAGAAGCTATAGATGAAGTGAAAAGACAGTGGAGAGAAGTTGCT<br>TCACTTCAGGCTGTTATGAAAGAAACAGTTCGTGACTATGAGCACCAGTT<br>CCACCTTAGGCTGGAGCAGGAGCGAACAGTGGGCACAGTATAGAGAA<br>TCCGCAGAGAGGGAAATAGCTGATTTAAGAAGAAGGCTGTCTGAAGGTC<br>AAGAGGAGGAAAATTTAGAAAATGAAATGAAAAAGGCCCAAGAGGATG<br>CTGAGAAACTTCGGTCCGTTGTGATGCCAATGGAAAAGGAAATTGCAGCT | SEQ ID NO: 30 |

TABLE B-continued

| Gene Fusion | Chimera Sequence | SEQ ID NO. |
|---|---|---|
| | TTGAAGGATAAACTGACAGAGGCTGAAGACAAAATTAAAGAGCTGGAGG<br>CCTCAAAGGTTAAAGAACTGAATCATTATCTGGAAGCTGAGAAATCTTGT<br>AGGACTGATCTAGAGATGTATGTAGCTGTTTTGAATACTCAGAAATCTGT<br>TCTACAGGAAGATGCTGAGAAACTGCGGAAAGAATTGCATGAAGGGTCT<br>TCTGAAGACGGCCCTGGATTTCCACAAACTGGGAAAGGTGGAGTTCAGC<br>GGCGTCAGAGGGAATGCTCTGAGTCAGCAGGTCCAGCAAATGCATGAAG<br>AATTTCAAGAGATGTACAGGCTTCTCTCAGGATCCTCCTCCGACTGCCTGT<br>ACCTCCAAAGCACGGACTTTGAAAATGACGTCTCTGAATTTAACCAGAAA<br>GTAGAAGATCTTGACCGAAGATTGGGGACTATCTTTATTCAAGCTTTTGA<br>TGATGCACCTGGCTTGGAGCATGCCTTTAAGCTGCTAGACATAGCAGGAA<br>ACCTCCTTGAAAGACCGCTGGTAGCGAGGGATACATCTGATAAATACCTG<br>GTCCTCATCCAAATGTTCAACAAAGATCTGGATGCAGTGAGGATGATCTA<br>CAGTCAGCACGTCCAGGAGGAAGCAGAACTTGGGTTCTCCCGGTGCAC<br>AAGAACATGCCCACCGTGGCTGGCGGCCTCCGCTGGGCACAGGAGCTGA<br>GGCAGCGCATCCAGGGTCCTTTCAGCAACTTTGGACGCATCACACACCCT<br>TGCATGGAATCTGCAGAAGGAAAGCGAATGCAACAAAAATATGAAGATA<br>TGCTGTCATTGCTAGAAAAGTATGAGACAAGACTTTATGAGGATTGGTGC<br>CGGACAGTATCAGAGAAGTCACAGTACAATCTTTCCCAACCACTTCTAAA<br>ACGTGACCCAGAGACGAAGGAGATCACTATCAACTTTAACCCACAGCTG<br>ATTTCAGTGCTGAAAGAAATGAGCTATCTTGAACCCAGAGAGATGAAAC<br>ACATGCCTGAGACAGCAGCAGCCATGTTCTCCTCCAGGGATTTCTATCGG<br>CAGCTTGTGGCTAATTTAGAGTTGATGGCAAATTGGTACAACAAGGTTAT<br>GAAAACTCTGCTGGAGGTGGAATTTCCATTAGTGGAGGAAGAGCTGCAA<br>AATATTGATCTCCGCCTCAGAGCAGCAGAGGAGACTTTGAACTGGAAAA<br>CAGAAGGCATTTGCGATTATGTCACTGAAATCACCAGTAGTATTCATGAT<br>CTTGAACAAAGAATTCAGAAAACTAAAGACAATGTGGAAGAGATCCAAA<br>ACATCATGAAAACATGGGTGACTCCAATATTTAAGACAAAAGATGGAAA<br>AAGGGAATCCCTTCTTTCTGGATGATCGGCATGATCGAATGGAAAAAT<br>ATTACAATCTCATCAAGGAATCTGGCCTTAAGATCCACGCCCTTGTTCAG<br>GAAAAACCTGGGTCTATTTTCAGCAGACCCAACCTCCAATATCTGGAAGAC<br>TTATGTTAACTCTATTGACAATTTGTTGCTGAATGGATTCTTTCTTGCCATT<br>GAGTGCTCCCTCAAGTATCTTCTGGAAAATACTGAGTGTAAGGCAGGACT<br>TACCCCAATATTTGAAGCACAACTGAGTCTAGCCATCCCAGAGCTAGTTT<br>CTATCCGTCTCTGGAGTCTGGAGTGAAGGGGGTTTCTGTGACATTGTT<br>GAGGGTCTCATCACCAGCATTTTTAGGATACCATCTCTGGTGCCACGGCT<br>TTCCCCACAAAATGGCTCTCCTCACTATCAGGTCGACCTGGACGGTATAC<br>CAGATTTGGCAAACATGCGGCGCACACTCATGGAGAGAGTCCAGAGAAT<br>GATGGGCCTCTGCTGTGGCTATCAGAGCACCTTCAGCCAGTATTCGTACC<br>TCTATGTGGAGGACCGGAAGGAGGTTCTGGGTCAGTTTCTGCTGTACGGG<br>CACATCCTCACTCCGGAAGAAATTGAAGACCATGTGGAAGATGGCATCCC<br>AGAGAACCCTCCCCTCCTTTCTCAGTTTAAAGTGCAAATCGACTCCTATG<br>AAACGCTCTATGAAGAGGTGTGCAGGCTGGAACCCATCAAGGTGTTTGAC<br>GGCTGGATGAAAATTGATATTCGACCCTTTAAGGCATCTCTGCTGAATAT<br>TATTAAGAGGTGGAGCCTCCTGTTCAAACAGCATCTTGTGGACCACGTCA<br>CTCACAGCTTGGCCAACCTGGATGCGTTTATAAAGAAGAGTGAGAGCGG<br>CTTACTCAAGAAAGTTGAAAAAGGAGATTTCCAAGGCTTGGTTGAGATCA<br>TGGGACACCTTATGGCTGTTAAAGAACGGCAGAGTAACACTGATGAGAT<br>GTTTGAGCCCTTAAAGCAGACTATTGAATTGCTGAAGACCTATGAACAAG<br>AATTGCCAGAAACAGTGTTTAAGCAGCTGGAGGAGCTGCCTGAGAAATG<br>GAACAACATAAAAAAGGTGGCCATTACTGTGAAGCAGCAGGTGGCCCCA<br>CTGCAGGCAAATGAAGTGACACTCCTCCGCCAGAGGTGCACAGCCTTCGA<br>TGCAGAACAGCAGCAATTCTGGGAGCAATTCCACAAAGAAGCCCCGTTC<br>AGGTTTGATAGCATCCACCCTCATCAAATGCTGGATGCCAGGCACATCGA<br>GATCCAGCAGATGGAATCCACTATGGCCTCCATTTCTGAGTCTGCCAGCT<br>TATTTGAAGTCAATGTCCCTGACTATAAGCAGCTGAGGCAGTGCAGGAAG<br>GAGGTCTGCCAGCTGAAGGAGCTCTGGGACACCATTGGAATGGTGACCTC<br>CAGCATCCATGCCTGGGAGACCACACCCTGGAGGAATATCAACGTGGAA<br>GCCATGGAGTTGGAGTGCAAACAGTTTGCCCGGCATATCCGAAACCTGGA<br>CAAGGAGGTCAGGGCCTGGGATGCATTCACAGGCCTGGAAAGCACTGTG<br>TGGAACACGCTGAGCTCCCTGAGGGCAGTAGCTGAGCTGCAGAATCCAG<br>CCATCCGGGAGCGGCACTGGAGGCAGCTGATGCAGGCCACCGGTGTGAG<br>CTTCACTATGGACCAGGACACCACCCTAGCGCACCTGCTGCAGCTCCAGC<br>TGCACCACTATGAGGATGAGGTCCGGGGCATTGTGGACAAAGCTGCAAA<br>AGAGATGGGTATGGAGAAAACCTTAAAGGAGCTGCAGACTACCTGGGCT<br>GGCATGGAATTCCAGTATGAGCCCCACCCACGGACCAATGTCCCCCTCCT<br>GTGCTCTGATGAGGACCTCATAGAGGTTCTGGAGGATAATCAAGTTCAAC<br>TTCAGAACCTGGTGATGTCCAAGTATGTTGCTTTCTTCTTGGAGGAGGTGT<br>CGGGCTGGCAGAAGAAGCTGTCCACAGTGGACGCTGTCATCTCTATCTGG<br>TTTGAAGTGCAGCGAACATGGACTCACCTGGAAAGCATATTCACTGGATC<br>TGAAGATATTCGGGCACAGCTACCCCAGGATTCTAAAAGGTTTGAAGGCA<br>TCGACATTGACTTTAAAGAGCTAGCTTATGATGCCCAGAAAATTCCAAAT<br>GTAGTGCAAACCACCAACAAGCCAGGCCTGTATGAAAAGCTGGAGGATA<br>TTCAGGGCAGATTGTGCCTGTGTGAGAAGGCCCTGGCAGAGTACCTCGAC<br>ACCAAGAGGCTTGCCTTCCCGCGGTTTTACTTTCTCTCCTCCTCCGATCTG<br>TTAGACATCCTTTCCAACGGCACAGCTCCACAACAGGTTCAACGTCACCT<br>TTCCAAACTCTTTGACAACATGGCCAAGATGCGATTCCAGCTAGATGCCA<br>GTGGGGAACCAACCAAGACAAGCCTCGGCATGTACAGCAAAGAAGAGGA | |

TABLE B-continued

| Gene Fusion | Chimera Sequence | SEQ ID NO. |
|---|---|---|
| | GTATGTGGCTTTCAGTGAGCCCTGTGACTGCAGCGGGCAGGTAGAAATAT<br>GGCTGAACCATGTCCTTGGTCACATGAAGGCCACTGTGAGGCATGAGATG<br>ACAGAAGGTGTAACTGCCTATGAAGAAAAGCCGAGGGAGCAGTGGCTTT<br>TTGACCACCCAGCTCAGGTGGCCCTGACCTGTACTCAGATCGGTGGACA<br>ACAGAAGTGGGCATGGCATTTGCCAGGCTGGAGGAAGGCTATGAGAGTG<br>CCATGAAGGACTATTATAAGAAGCAAGTGGCCCAGCTCAAAACCCTTATC<br>ACCATGCTGATTGGCCAGCTCTCCAAGGGAGACCGGCAGAAGATTATGA<br>CTATATGCACCATCGATGTGCATGCCGGGATGTGGTAGCCAAGATGATT<br>GCTCAGAAGGTAGACAATGCCCAGGCTTTCCTCTGGCTGTCTCAGCTGCG<br>CCATCGTTGGGATGACGAGGTCAAACACTGCTTTGCCAACATCTGTGATG<br>CCCAGTTTTTGTATTCCTATGAGTACCTGGGAAACACACCTCGCTTGGTGA<br>TCACACCTTTGACTGACAGGTGCTACATCACCCTCACCCAGTCCCTGCAC<br>CTGACCATGAGTGGGGCTCCCGCAGGACCTGCAGGCACAGGCAAGACCG<br>AGACCACCAAGGACCTGGGCCGCGCACTGGGCATCCTGGTCTATGTGTTC<br>AACTGCTCGGAGCAGATGGATTACAAGTCTTGTGGCAACATCTACAAAGG<br>CCTTGCTCAGACTGGTGCCTGGGGCTGCTTTGATGAGTTTAATCGAATCTC<br>CGTGGAGGTCTTGTCAGTGGTGGCAGTGCAGGTAAAAAGCATTCAAGAT<br>GCGATTAGAGATAAGAAGCAGTGGTTCAGCTTCCTTGGGGAGGAGATCA<br>GCCTGAATCCTTCTGTCGGTATCTTCATCACCATGAACCCAGGCTATGCTG<br>GCCGCACAGAGCTGCCAGAGAATCTCAAGTCTCTCTTCAGGCCTTGTGCA<br>ATGGTGGTTCCAGACTTTGAATTGATCTGTGAAATCATGCTGGTGGCAGA<br>AGGATTCATTGAAGCCCAGTCATTAGCCAGAAAGTTCATCACTCTTTACC<br>AGTTGTGCAAAGAGCTTCTCTCCAAACAGGATCACTACGACTGGGGCCTA<br>CGGGCCATCAAGTCCGTGCTGGTGGTGGCAGGATCCCTGAAGAGAGGAG<br>ACCCTGACCGGCCTGAGGACCAGGTCCTGATGCGCTCCTTGCGGGATTTC<br>AACATCCCCAAGATTGTGACTGATGACATGCCCATCTTCATGGGCCTGAT<br>CGGGGACCTCTTTCCCGCCCTGGATGTCCCCCGGAGGAGAGACCCCAACT<br>TCGAAGCTTTGGTTAGGAAGGCGATAGTGGATCTGAAGCTCCAGGCTGAG<br>GACAACTTTGTGCTCAAGGTGGTCCAGCTGGAGGAGCTCCTGGCTGTGCG<br>GCACTCTGTATTTGTGGTGGGTGGCGCTGGTACCGGCAAGTCACAGGTGC<br>TGAGGTCCTTGCACAAGACCTATCAGATCATGAAACGGCGCCCCGTCTGG<br>ACTGACCTCAATCCCAAAGCAGTCACAAATGATGAGCTCTTTGGCATCAT<br>CAATCCAGCCACAGGAGAATGGAAGGATGGATTGTTCTCTTCCATCATGC<br>GGGAGCTTGCCAACATCACCCATGATGGGCCCAAGTGGATTTTACTGGAT<br>GGCGACATAGATCCAATGTGGATTGAATCCCTGAATACTGTCATGGATGA<br>TAACAAGGTGCTGACATTGGCCAGCAATGAGAGGATTCCTCTGAACCCCA<br>CCATGAAGCTCCTCTTTGAGATCAGCCACCTGCGCACAGCCACTCCAGCA<br>ACTGTCTCTAGAGCAGGGATCTTGTACATCAACCCGGCAGACTTGGGATG<br>GAACCCTCCAGTGAGCAGCTGGATTGAGAAGAGGGAAATCCAGACAGAG<br>AGAGCCAACTTAACCATTTTGTTCGACAAGTATCTTCCAACCTGCCTAGA<br>CACACTCAGAACCAGGTTTAAGAAGATCATTCCCATCCCAGAGCAGAGC<br>ATGGTTCAGATGGTGTGTCACCTTCTGGAATGTCTCCTGACCACGGAGGA<br>CATCCCTGCAGACTGCCCTAAGGAAATTTATGAGCATTATTTTGTGTTTGC<br>TGCCATCTGGGCTTTCGGCGGAGCAATGGTCCAAGATCAGCTTGTGGACT<br>ACCGGGCAGAGTTCAGCAAATGGTGGCTGACTGAGTTCAAAACAGTCAA<br>GTTTCCTTCCCAAGGAACCATCTTTGACTATTACATCGACCCAGAGACCA<br>AGAAATTCGAGCCTTGGTCCAAGCTCGTCCCCCAGTTCGAATTTGACCCC<br>GAGATGCCCTTGCAGGCGTGTTTGGTGCACACGAGTGAGACCATCCGTGT<br>GTGCTACTTCATGGAGCGGTTGATGGCGCGGCAGCGGCCTGTCATGCTGG<br>TGGGCACGGCTGGCACTGGCAAGTCGGTGCTGGTGGGAGCTAAGCTGGC<br>CAGCCTTGACCCCGAGGCATACCTGGTGAAAAACGTGCCATTCAACTACT<br>ACACCACGTCAGCAATGCTGCAGGCTGTCCTGGAGAAGCCTCTGGAAAA<br>GAAGGCTGGCAGAAACTATGGCCCTCCAGGGAACAAGAAACTCATCTAT<br>TTCATTGATGACATGAACATGCCTGAGGTGGATGCCTACGGGACGGTGCA<br>GCCCCACACCATCATCCGGCAGCATCTGGACTATGCCACTGGTATGATC<br>GGAGCAAGCTGTCCCTAAAGGAGATCACAAATGTACAGTATGTTTCCTGT<br>ATGAACCCACGGCAGGCAGCTTCACCATCAACCCCGGCTTCAGCGTCA<br>CTTCAGCGTGTTTGTCCTCTCCTTCCGGGGGCAGATGCCCTGTCCTCTAT<br>CTACAGCATCATCCTCACTCAGCATCTGAAGCTCGGAAACTTCCCGGCGT<br>CCCTGCAGAAATCCATCCCCCCACTGATCGATCTGGCCCTCGCCTTCCACC<br>AGAAAATTGCTACCACCTTCCTACCCACAGGAATCAAATTCCACTACATC<br>TTCAACCTCAGAGATTTTGCCAACATTTTCCAGGGCATTCTCTTCTCCTCA<br>GTGGAATGTGTGAAATCCACATGGGATCTTATAAGGCTCTATCTGCATGA<br>ATCAAATCGAGTTTATCGGGATAAGATGGTAGAAGAAAAGGACTTTGAT<br>CTTTTTGATAAAATCCAGACAGAAGTGCTCAAGAAAACTTTTGATGATAT<br>TGAAGACCCTGTGGAGCAGACCCAAAGCCCGAACCTGTATTGTCACTTTG<br>CAAATGGTATTGGGGAGCCCAAATACATGCCTGTACAGTCTTGGGAACTT<br>TTGACCCAGACTCTGGTGGAGGCCTTGGAGAACACAATGAAGTCAACA<br>CAGTGATGGACCTAGTTCTCTTTGAGGATGCCATGCGCCATGTCTGCCAT<br>ATCAATCGCATCTTGGAGTCCCCGCGGGGAAATGCTCTGCTGGTTGGTGT<br>AGGTGGGAGCGGCAAGCAGAGCCTGACAAGGCTGGCAGCTTTCATCAGC<br>TCCATGGATGTCTTCCAGATCACACTGCGCAAAGGCTACCAGATCCAGGA<br>CTTCAAGATGGACCTGGCCAGCCTGTGTCTGAAAGCTGGAGTGAAGAATC<br>TCAACACAGTGTTTCTCATGACTGATGCCCAAGTGGCTGATGAGAGGTTC<br>CTTGTGCTCATCAATGATCTTTTGGCATCTGGGGAGATCCCAGATCTCTAC<br>TCTGATGATGAAGTTGAAAACATCATAAGCAATGTGAGGAATGAAGTCA<br>AGAGCCAGGGTCTGGTTGACAACAGAGAGAACTGTTGGAAGTTCTTTATA | |

TABLE B-continued

| Gene Fusion | Chimera Sequence | SEQ ID NO. |
|---|---|---|
| | GATCGGATCCGGCGACAGCTGAAGGTGACTCTCTGTTTCTCCCCTGTGGG | |
| | AAACAAGCTAAGAGTCCGCAGCAGGAAGTTCCCAGCCATTGTGAACTGC | |
| | ACAGCCATCCACTGGTTCCACGAGTGGCCTCAGCAAGCATTGGAGTCTGT | |
| | CAGCCTCCGCTTCTTGCAGAACACAGAGGGCATTGAGCCCACAGTAAAGC | |
| | AGTCGATTAGCAAATTCATGGCCTTTGTCCACACAAGTGTCAACCAAACA | |
| | TCCCAGTCTTATCTGAGCAATGAACAGCGCTACAACTATACAACTCCCAA | |
| | GTCCTTTCTGGAGTTCATCAGACTCTACCAGAGCTTGTTGCACAGGCACA | |
| | GAAAAGAGCTCAAGTGCAAGACAGAGCGGTTGGAGAACGGGCTGCTGAA | |
| | GCTGCATAGCACCTCTGCCCAGGTGGATGATCTGAAAGCAAAGCTGGCTG | |
| | CCCAGGAAGTAGAGCTGAAGCAGAAAAATGAAGATGCAGACAAACTGAT | |
| | TCAGGTCGTGGGTGTGGAGACTGACAAAGTGAGCAGAGAGAAAGCCATG | |
| | GCAGATGAAGAGGAGCAGAAGGTGGCCGTCATCATGCTAGAGGTGAAAC | |
| | AGAAGCAGAAGGACTGTGAGGAGGACCTGGCAAAGGCTGAGCCAGCACT | |
| | CACAGCAGCGCAGGCAGCTCTCAACACCCTGAACAAGACCAACCTGACA | |
| | GAGCTGAAGTCATTTGGCTCTCCGCCTCTGGCCGTCAGCAATGTCAGCGC | |
| | TGCGGTGATGGTACTGATGGCTCCCAGGGGTAGGGTGCCCAAGGACCGG | |
| | AGCTGGAAGGCTGCTAAGGTCACCATGGCCAAAGTGGATGGCTTCCTGG | |
| | ACTCGCTAATAAACTTCAACAAAGAGAACATTCACGAGAACTGCCTCAA | |
| | AGCCATCAGGCCGTATCTGCAAGACCCCGAGTTCAATCCTGAGTTTGTGG | |
| | CCACCAAATCCTATGCGGCTGCAGGCCTCTGCTCCTGGGTCATCAATATT | |
| | GTGAGATTTTATGAGGTGTTCTGTGATGTGGAACCCAAGCGCCAGGCACT | |
| | GAACAAAGCCACCGCGGACCTCACAGCTGCCCAGGAGAAGCTGGCTGCC | |
| | ATCAAAGCCAAGATCGCTCACCTTAATGAAAACCTGGCAAAGCTCACAG | |
| | CCAGGTTTGAGAAAGCAACAGCAGACAAACTCAAATGTCAGCAAGAAGC | |
| | CGAAGTGACCGCAGTCACCATCTCCCTTGCCAACCGCCTGGTTGGAGGAC | |
| | TCGCTTCTGAAAACGTGAGGTGGGCAGATGCCGTGCAGAACTTCAAACA | |
| | GCAGGAAAGGACGTTATGTGGAGACATTTTACTTATAACGGCTTTCATTT | |
| | CCTACCTTGGCTTCTTCACAAAGAAATACCGGCAGAGCCTCCTGGACAGA | |
| | ACTTGGAGGCCCTACCTGAGCCAGCTGAAAACTCCCATTCCAGTCACCCC | |
| | AGCCCTGGATCCCCTGAGGATGCTGATGGATGATGCTGACGTGGCTGCCT | |
| | GGCAGAACGAGGGCCTCCCAGCCGACCGCATGTCCGTGGAGAATGCCAC | |
| | CATTCTCATCAACTGTGAGCGCTGGCCACTCATGGTTGACCCTCAGCTAC | |
| | AAGGCATCAAATGGATCAAGAATAAATATGGTGAAGATCTCCGGGTCAC | |
| | GCAGATTGGTCAGAAAGGCTACCTTCAAATCATAGAGCAGGCCCTGGAA | |
| | GCTGGAGCTGTGGTGCTGATTGAAAATCTAGAGGAGTCCATTGATCCTGT | |
| | TCTGGGACCCCTGCTTGGGAGAGAAGTCATTAAAAAAGGACGATTCATTA | |
| | AAATTGGAGACAAAGAATGTGAATACAATCCCAAGTTCCGGCTCATCCTC | |
| | CACACCAAGCTGGCTAATCCTCACTACCAGCCTGAGCTGCAGGCTCAGGC | |
| | CACCCTGATCAACTTCACCGTGACCAGGGATGGCCTGGAGGACCAGTTGC | |
| | TGGCCGCTGTGGTCAGCATGGAGAGGCCAGACTTGGAGCAGCTGAAGTC | |
| | CGATCTCACAAAGCAGCAGAATGGATTCAAAATTACCCTGAAAACGTTG | |
| | GAAGACAGTCTTCTCTCTCGCCTCTCCTCCGCCTCTGGGAACTTCCTGGGA | |
| | GAAACAGTGCTGGTGGAAAAACCTAGAGATCACCAAGCAGACTGCTGCCG | |
| | AAGTTGAGAAAAAGGTCCAGGAGGCCAAGGTGACTGAAGTGAAAATCAA | |
| | CGAGGCCCGAGAGCACTACCGGCCAGCAGCTGCCAGGGCCTCACTGCTCT | |
| | ACTTCATCATGAACGACCTCAGCAAGATCCATCCAATGTACCAGTTTTCT | |
| | CTCAAGGCCTTCAGTATCGTCTTCCAGAAGGCTGTGGAGAGGGCTGCTCC | |
| | TGACGAAAGCCTCAGGGAGCGGGTGGCCAACCTAATAGACAGCATAACC | |
| | TTCTCTGTGTACCAGTACACCATCCGCGGGCTCTTTGAGTGTGATAAGCTG | |
| | ACCTACCTTGCCCAGCTCACCTTTCAGATTCTCCTCATGAACCGAGAAGTC | |
| | AATGCAGTGGAGTTGGATTTCCTGCTTCGATCTCCAGTGCAGACGGGCAC | |
| | CGCCAGCCCCGTGGAGTTCCTCTCCCATCAGGCGTGGGGAGCTGTCAAGG | |
| | TACTTTCATCAATGGAAGAATTCTCTAATCTGGATCGGGACATAGAGGGA | |
| | TCTGCTAAGAGCTGGAAAAAGTTTGTGGAGTCCGAATGTCCTGAGAAAG | |
| | AGAAGCTCCCACAGGAGTGGAAGAACAAGACAGCCCTGCAGCGCCTCTG | |
| | CATGCTGAGAGCCATGCGGCCCGACCGGATGACCTATGCTTTGCGAGATT | |
| | TTGTTGAAGAGAAGTTAGGAAGCAAATACGTGGTGGGAAGAGCCCTAGA | |
| | TTTTGCAACCTCATTTGAAGAATCGGGACCAGCCACTCCTATGTTTTTCAT | |
| | CCTGTCTCCAGGGGTGGACCCACTGAAGGATGTAGAAAGTCAAGGAAGA | |
| | AAACTTGGATACACCTTCAACAATCAGAACTTTCACAACGTGTCTTTGGG | |
| | GCAAGGACAGGAAGTGGTGGCTGAGGCTGCGCTGGACCTCGCTGCCAAG | |
| | AAAGGTCACTGGGTTATTTTGCAGAACATTCACCTGGTGGCCAAGTGGCT | |
| | CAGCACCCTGGAGAAGAAGCTGGAGGAGCACAGTGAGAACAGCCACCCA | |
| | GAGTTCAGGGTCTTCATGAGTGCAGAGCCAGCACCCTCCCCTGAGGGCCA | |
| | CATCATCCCCCAGGGCATCCTGGAGAACTCCATTAAGATCACCAATGAGC | |
| | CCCCCACGGGCATGCATGCCAACCTGCACAAGGCCCTGGACAACTTCACT | |
| | CAGGACACTCTGGAGATGTGTTCTCGGGAGACGGAGTTTAAGAGCATCCT | |
| | CTTTGCTCTTTGTTACTTCCATGCGGTGGTGGCAGAAAGACGAAAATTTG | |
| | GGCCCCAGGGATGGAATCGCTCATACCCCTTTAACACTGGAGACCTCACT | |
| | ATCTCTGTGAATGTCCTCTACAACTTCCTGGAGGCCAACGCAAAGGTCCC | |
| | CTATGATGATTTGCGCTACCTGTTTGGAGAGATCATGTATGGAGGCCATA | |
| | TCACAGATGACTGGGACAGAGACTTCTGCAGAACCTACCTGGGGGAATT | |
| | CATTGACCAGAAATGTTAGAAGGAGAACTGTCTTTGGCCCCAGGGTTCC | |
| | CACTCCCAGGCAACATGGACTACAATGGTATCATCAGTACATCGGATGCT | |
| | GAGCTGCCCCAGAATCCCCCTACCTCTATGGCTCCACCCGAACGCAGA | |
| | GATTGGCTTCCTGACCCAAACCTCAGAAAAGCTCTTCCGCACTGTGCTGG | |
| | AGCTGCAGCCTCGGGACAGCCAGGCCAGAGACGGAGCGGGCGCCACAAG | |

TABLE B-continued

| Gene Fusion | Chimera Sequence | SEQ ID NO. |
|---|---|---|
| | AGAAGAAAAGGTCAAGGCACTTCTGGAAGAAATATTGGAGCGGGTGACA<br>GACGAGTTTAACATCCCAGAACTGATGGCCAAAGTGGAGGAGCGCACCC<br>CTTACATTGTAGTTGCCTTCCAGGAGTGTGGCCGGATGAATATCCTCACC<br>AGAGAGATTCAGCGCTCACTGAGGGAGCTGGAGCTCGGCTTAAAGGGGG<br>AGCTGACTATGACCAGCCACATGGAGAACTTACAGAATGCCCTGTACTTC<br>GATATGGTGCCAGAGTCCTGGGCTAGACGAGCCTACCCTTCCACAGCAGG<br>CCTGGCAGCCTGGTTTCCAGACCTCCTCAACAGAATCAAGGAGCTAGAGG<br>CTTGGACGGGTGACTTTACAATGCCCTCCACTGTGTGGCTGACAGGCTTC<br>TTCAACCCCCAGTCGTTCCTGACTGCCATCATGCAGTCCACGGCTCGCAA<br>GAATGAGTGGCCACTGGACCAGATGGCCCTGCAATGTGACATGACGAAG<br>AAGAACAGAGAAGAGTTTAGGAGTCCTCCTCGGGAAGGGGCCTACATCC<br>ATGGGCCTCTTCATGGAAGGTGCCTGCTGGGACACACAGGCTGGGATCATT<br>ACAGAGGCAAAGCTGAAGGATCTGACACCCCTATGCCTGTGATGTTCAT<br>CAAGGCCATTCCTGCAGATAAGCAGGACTGCCGCAGTGTCTATTCCTGTC<br>CTGTGTACAAGACTAGTCAGCGGGGACCCACCTACGTGTGGACTTTCAAC<br>CTGAAGACTAAGGAAAACCCATCCAAGTGGGTTCTGGCTGGAGTAGCCTT<br>GCTTCTCCAGATTTAG | |
| C10orf137 -><br>LOC100169752 | ATGGGGGATGCCAAGGAGGCCGGAGCCGAGGGTCCGCCGGCCGGGGCCG<br>CCGCTCGAGGAGGGCTCAGCCTCCTGTCCCAGGGAGAATCCGAGGAATCT<br>TCTGCACAGGGATCAGCTTTATTTCTTGGAGGCAATGAAGTGAAGAGCCG<br>AGCTGTGGTGAAATACTCTTCTGCCCCTCCTCGAACAGCATTTGCACGCCT<br>TGAAGAGAAAACAGACTTGAAACTCCCACCTGCCAACTGGTTACGAGAG<br>AGTGCCAAACTAGGGCCAGCAGGAACTACCATTCTTGGCAACAGCAAGA<br>AAAGCAAGCCATTTTCAAGCTTTGGCATGGCATATGACTTTATTGATTCA<br>GTGGGAAATGATGTGGATGTTGTCTCTGACTCTGAAGTGAGGAGAAGATG<br>CTGTTCTGAGAGCTGCTGATAATACGTGGATCCAAACCCACAGGCTTGAG<br>CTGCTTAATTGAAATTCACGTCAAAATGAAATTCTGGTTTAGCTCAACTTG<br>ACTACTATGGATGATGAAAATAAATCCCTGGGTCACACAAGGATAGTGAT<br>TGAGTAGAGCTTGTTTGCTGGCACAGGAATGACATTTCAACTGGAATTAA<br>ATTGTCGTCAGTTAACAGAAC | SEQ ID<br>NO: 31 |
| TFG-><br>GPR128 | ATGAACGGACAGTTGGATCTAAGTGGGAAGCTAATCATCAAAGCTCAAC<br>TTGGGGAGGATATTCGGCGAATTCCTATTCATAATGAAGATATTACTTAT<br>GATGAATTAGTGCTAATGATGCAACGAGTTTTTCAGAGGAAAACTTCTGAG<br>TAATGATGAAGTAACAATAAAGTATAAAGATGAAGATGGAGATCTTATA<br>ACAATTTTTGATAGTTCTGACCTTTCCTTTGCAATTCAGTGCAGTAGGATA<br>CTGAAACTGACATTATTTGGAAAATCTACTTCCTCATCAAGCACCCCTAC<br>AGAGTTCTGCAGGAATGGTGGAACCTGGGAAAATGGCAGATGTATTTGT<br>ACAGAAGAGTGGAAAGGACTGAGATGTACAATTGCTAATTTTTGTGAAA<br>ATAGTACCTATATGGGTTTTACTTTTGCCAGAATCCCAGTGGGCAGATAT<br>GGACCATCCTTGCAAACATGTGGCAAGGATACTCCAAATGCGGGCAATCC<br>AATGGCAGTCCGGTTGTGCAGTCTCTCTCTATATGGAGAGATAGAATTAC<br>AAAAAGTGACAATAGGAAATTGCAATGAAAATCTGGAAACCCTGGAAAA<br>GCAGGTAAAGGATGTCACAGCACCACTTAATAACATTTCTTCTGAAGTCC<br>AGATTTTAACATCTGATGCCAATAAATTAACTGCTGAGAACATCACTAGT<br>GCTACGCGAGTGGTTGGACAGATATTCAACACTTCCAGAAATGCTTCACC<br>TGAGGCAAAGAAAGTTGCCATAGTAACAGTGAGTCAACTCCTAGATGCC<br>AGTGAAGATGCTTTTCAAAGAGTTGCTGCTACTGCTAATGATGATGCCCT<br>TACAACGCTTATTGAGCAAATGGAGACTTATTCCTTGTCTTTGGGTAATCA<br>ATCAGTGGTGGAACCTAACATAGCAATACAGTCAGCAAATTTCTCTTCAG<br>AAAATGCGGTGGGGCCTTCAAATGTTCGCTTCTCTGTGCAGAAAGGAGCT<br>AGCAGTTCTCTAGTTTCTAGTTCAACATTTATACATACAAATGTGGATGGC<br>CTTAACCCAGATGCACAGACTGAGCTTCAGGTCTTGCTTAATATGACGAA<br>AAATTACACCAAGACATGCGGCTTTGTAGTTTATCAAAATGACAAGCTTT<br>TCCAATCAAAAACTTTTACAGCTAAATCGGATTTTAGTCAAAAAATTATC<br>TCAAGCAAAACTGATGAAAATGAGCAAGATCAGAGTGCTTCTGTTGACAT<br>GGTCTTTAGTCCAAAGTACAACCAAAAGAATTTCAACTCTATTCCTATG<br>CCTGTGTCTATTGGAATTTGTCAGCGAAGGACTGGGACACATATGGCTGT<br>CAAAAAGACAAGGGCACTGATGGATTCCTGCGCTGCCGCTGCAACCATA<br>CTACTAATTTTGCTGTATTAATGACTTTCAAAAAGGATTATCAATATCCCA<br>AATCACTTGACATATTATCCAACGTTGGATGTGCACTGTCTGTTACTGGTC<br>TGGCTCTCACAGTTATATTTCAGATTGTCACCAGGAAAGTCAGAAAAACC<br>TCAGTAACCTGGGTTTTGGTCAATCTGTGCATATCAATGTTGATTTTCAAC<br>CTCCTCTTTGTGTTTGGAATTGAAAACTCCAATAAGAACTTGCAGACAAG<br>TGATGGTGACATCAATAATATTGACTTTGACAATAATGACATACCCAGGA<br>CAGACACCATTAACATCCCGAATCCATGTGCACTGCGATTGCCGCCTTA<br>CTGCACTATTTTCTGTTAGTGACATTTACCTGGAACGCACTCAGCGCTGCA<br>CAGCTCTATTACCTTCTAATAAGGACCATGAAGCCTCTTCCTCGGCATTTC<br>ATTCTTTTCATCTCATTAATTGGATGGGGAGTCCCAGCTATAGTAGTGGCT<br>ATAACAGTGGGAGTTATTTATTCTCAGAATGGAAATAATCCACAGTGGGA<br>ATTAGACTACCGGCAAGAGAAAATCTGCTGGCTGGCAATTCCAGAACCC<br>AATGGTGTTATAAAAAGTCCGCTGTTGTGGTCATTCATCGTACCTGTAAC<br>CATTATCCTCATCAGCAATGTTGTTATGTTTATTACAATCTCGATCAAAGT<br>GCTGTGGAAGAATAACCAGAACCTGACAAGCACAAAAAAGTTTCATCC<br>ATGAAGAAGATTGTTAGCACATTATCTCGTTGCAGTTGTTTTGGAATTACC<br>TGGATTCTAGCATACCTGATGCTAGTAATGATGATAGCATCAGGATCGT | SEQ ID<br>NO: 32 |

TABLE B-continued

| Gene Fusion | Chimera Sequence | SEQ ID NO. |
|---|---|---|
| | CTTCAGCTACATATTCTGCCTTTTCAACACTACACAGGGATTGCAAATTTT<br>TATCCTGTACACTGTTAGAACAAAAGTCTTCCAGAGTGAAGCTTCCAAAG<br>TGTTGATGTTGCTATCGTCTATTGGGAGAAGGAAGTCATTGCCTTCAGTG<br>ACGCGGCCGAGGCTGCGTGTAAAGATGTATAATTTCCTCAGGTCATTGCC<br>AACCTTACATGAACGCTTTAGGCTACTGGAAACCTCTCCGAGTACTGAGG<br>AAATCACACTCTCTGAAAGTGACAATGCAAAGGAAAGCATCTAG | |
| LRP5-><br>SLC22A24 | ATGGAGGCAGCGCCGCCCGGGCCGCCGTGGCCGCTGCTGCTGCTGCTGCT<br>GCTGCTGCTGGCGCTGTGCGGCTGCCCGGCCCCCGCCGCGGCCTCGCCGC<br>TCCTGCTATTTGCCAACCGCCGGGACGTACGGCTGGTGGACGCCGGGA<br>GTCAAGCTGGAGTCCACCATCGTGGTCAGCGGCTGGAGGATGCGGCCG<br>CAGTGGACTTCCAGTTTTCCAAGGGAGCCGTGTACTGGACAGACGTGAGC<br>GAGGAGGCCATCAAGCAGACCTACCTGAACCAGACGGGGGCCGCCGTGC<br>AGAACGTGGTCATCTCCGGCCTGGTCTCTCCCGACGGCCTGCCTGCGAC<br>TGGGTGGGCAAGAAGCTGTACTGGACGGACTCAGAGACCAACCGCATCG<br>AGGTGGCCAACCTCAATGGCACATCCCGGAAGGTGCTCTTCTGGCAGGAC<br>CTTGACCAGCCGAGGGCCATCGCCTTGGACCCCGCTCACGGGTACATGTA<br>CTGGACAGACTGGGGTGAGACGCCCCGGATTGAGCGGGCAGGGATGGAT<br>GGCAGCACCCGGAAGATCATTGTGGACTCGGACATTTACTGGCCCAATGG<br>ACTGACCATCGACCTGGAGGAGCAGAAGCTCTACTGGGCTGACGCCAAG<br>CTCAGCTTCATCCACCGTGCCAACCTGGACGGCTCGTTCCGGCAGAAGGT<br>GGTGGAGGGCAGCCTGACGCACCCCTTCGCCCTGACGCTCTCCGGGGACA<br>CTCTGTACTGGACAGACTGGCAGACCCGCTCCATCCATGCCTGCAACAAG<br>CGCACTGGGGGAAGAGGAAGGAGATCCTGAGTGCCCTCTACTCACCCA<br>TGGACATCCAGGTGCTGAGCCAGGAGCGGCAGCCTTTCTTCCACACTCGC<br>TGTGAGGAGGACAATGGCGGCTGCTCCCACCTGTGCCTGCTGTCCCCAAG<br>CGAGCCTTTCTACACATGCGCCTGCCCCACGGGTGTGCAGCTGCAGGACA<br>ACGGCAGGACGTGTAAGGCAGCTTGTGAGATCCACCATGAAGAAGGAGT<br>TGGATGCAGTCCGAATTAAAACATCCATTTTTTCCCTGTTCCGTGCACCCA<br>AATTGCGAATGAGAGTCTTCGGCCTGTGCTTTGTGAGATTCGCAATCACT<br>GTACCCTTTTATGGCCTGATACTCAACTTGCAGCACTTAGGGAGCAATGT<br>CTCCCTGTTCCAGATTCTCTGTGGAGCTGTCACATTCACAGCCAGATGTGT<br>TTCCCTTTTGACACTGAATCATATGGGTCGTCGAATAAGCCAGATATTGTT<br>CACGTTCCCGGTGGGACTTTTCATTCTGGTCAACACCTTTTTGCCCCAAGA<br>AATGCAGATCCTGCGTGTGGTTTTAGCAACTTTGGGAATTGGTAGTGTTTC<br>TGCTGCTAGCAACAGTGCTTCTGTCCACCACAACGAGCTCGTCCCCACCA<br>TATTGAGGTCAACAGTTGCAGGAATCAATGCAGTGTCCGGTAGGACTGGG<br>GCAGCACTGGCTCCTCTGTTGATGACCTTAATGGCGTATTCTCCCCACCTA<br>CCCTGGATTTCCTATGGAGTCTTCCCCATCCTTGCTGTCCCTGTTATCCTCC<br>TCCTTCCAGAAACCAGGGATCTACCTCTTCCTAACACCATCCAGGATGTG<br>GAAAATGACAGAAAAGATTCAAGAAACATAAAGCAGGAAGATACTTGCA<br>TGAAAGTAACACAGTTTTAA | SEQ ID NO: 33 |
| PPP2R2D<br>-><br>PANK1 | AGCGGACATCATTTCCACCGTTGAGTTTAATTACTCTGGAGATCTTCTTGC<br>AACAGGAGACAAGGGCGGCAGAGTTGTTATTTTTCAGCGTGAACAAGAG<br>AATAAAAGCCGCCCTCATTCTAGGGGAGAATATAATGTTTACAGCACCTT<br>TCAAAGTCATGAACCGGAGTTTGACTATTTGAAAAGTCTAGAAATTGAGG<br>AAAAAATTAATAAAATTAGGTGGTTACCACAACAGAATGCTGCTCATTTT<br>CTACTGTCTACAAATGATAAAACTATAAAATTATGGAAAATAAGTGAACG<br>GGATAAAAGAGCAGAAGGTTATAACCTGAAAGACGAAGATGGAAGACTT<br>CGAGACCCATTTAGGATCACGGCGCTACGGGTCCCAATATTGAAGCCCAT<br>GGATCTTATGGTAGAAGCGAGTCCACGGCGAATTTTTGCAAATGCTCACA<br>CATATCATATAAATTCCATTTCAGTAAATAGTGATCATGAAACATATCTTT<br>CTGCAGATGACCTGAGAATTAATTTATGGCACTTAGAAATCACAGATAGA<br>AGCTTTAACATCGTGGACATCAAGCCTGCTAACATGGAGGAGCTGACCGA<br>AGTCATCACTGCAGCCGAGTTCCACCCGCACCAGTGCAACGTGTTCGTCT<br>ACAGCAGTAGCAAAGGGACCATCCGCCTGTGTGACATGCGCTCCTCGGCC<br>CTGTGCGACAGACACTCCAAGTTTTTTGAAGAGCCTGAAGATCCCAGCAG<br>TAGGTCCTTCTTCTCAGAAATAATTTCATCCATATCCGATGTAAAATTCAG<br>TCATAGTGGGCGGTACATGATGACCAGAGACTACCTGTCGGTGAAGGTGT<br>GGGACCTCAACATGGAGAGCAGGCCGGTGGAGACCCACCAGGTCCACGA<br>GTACCTGCGCAGCAAGCTCTGCTCTCTCTATGAGAACGACTGCATCTTTG<br>ACAAGTTTGAGTGTTGCTGGAACGGTTCGGATAGGGTTATTTTGGAGCCG<br>TTGGGGCACTGTTGGAACTGTTCAAAATGACTGATGACAAGTAG | SEQ ID NO: 34 |
| IGF1R-><br>DCC | ATGAAGTCTGGCTCCGGAGGAGGGTCCCCGACCTCGCTGTGGGGGCTCCT<br>GTTTCTCTCCGCCGCGCTCTCGCTCTGGCCGACGAGTGGAGAAATCTGCG<br>GGCCAGGCATCGACATCCGCAACGACTATCAGCAGCTGAAGCGCCTGGA<br>GAACTGCACGGTGATCGAGGGCTACCTCCACATCCTGCTCATCTCCAAGG<br>CCGAGGACTACCGCAGCTACCGCTTCCCCAAGCTCACGGTCATTACCGAG<br>TACTTGCTGCTGTTCCGAGTGGCTGGCCTCGAGAGCCTCGGAGACCTCTT<br>CCCCAACCTCACGGTCATCCGCGGCTGGAAACTCTTCTACAACTACGCCC<br>TGGTCATCTTCGAGATGACCAATCTCAAGGATATTGGGCTTTACAACCTG<br>AGGAACATTACTCGGGGGGCCATCAGGATTGAGAAAAATGCTGACCTCT<br>GTTACCTCTCCACTGTGGACTGGTCCCTGATCCTGGATGCGGTGTCCAATA<br>ACTACATTGTGGGGAATAAGCCCCCAAAGGAATGTGGGGACCTGTGTCC<br>AGGGACCATGGAGGAGAAGCCGATGTGTGAGAAGACCACCATCAACAAT | SEQ ID NO: 35 |

TABLE B-continued

| Gene Fusion | Chimera Sequence | SEQ ID NO. |
|---|---|---|
| | GAGTACAACTACCGCTGCTGGACCACAAACCGCTGCCAGAAAATGTGCC
CAAGCACGTGTGGGAAGCGGGCGTGCACCGAGAACAATGAGTGCTGCCA
CCCCGAGTGCCTGGGCAGCTGCAGCGCGCCTGACAACGACACGGCCTGT
GTAGCTTGCCGCCACTACTACTATGCCGGTGTCTGTGTGCCTGCCTGCCCG
CCCAACACCTACAGGTTTGAGGGCTGGCGCTGTGTGGACCGTGACTTCTG
CGCCAACATCCTCAGCGCCGAGAGCAGCGACTCCGAGGGGTTTGTGATCC
ACGACGGCGAGTGCATGCAGGAGTGCCCCTCGGGCTTCATCCGCAACGG
CAGCCAGAGCATGTACTGCATCCCTTGTGAAGGTCCTTGCCCGAAGGTCT
GTGAGGAAGAAAAGAAAACAAAGACCATTGATTCTGTTACTTCTGCTCAG
ATGCTCCAAGGATGCACCATCTTCAAGGGCAATTTGCTCATTAACATCCG
ACGGGGGAATAACATTGCTTCAGAGCTGGAGAACTTCATGGGGCTCATCG
AGGTGGTGACGGGCTACGTGAAGATCCGCCATTCTCATGCCTTGGTCTCC
TTGTCCTTCCTAAAAACCTTCGCCTCATCCTAGGAGAGGAGCAGCTAGA
AGGGTTTTCAAATTAAAGCTTTCACAGCACTGCGCTTCCTCTCAGAACCTT
CTGATGCCGTCACAATGCGGGGAGGAAATGTCCTCCTCGACTGCTCCGCG
GAGTCCGACCGAGGAGTTCCAGTGATCAAGTGGAAGAAAGATGGCATTC
ATCTGGCCTTGGGAATGGATGAAAGGAAGCAGCAACTTTCAAATGGGTCT
CTGCTGATACAAAACATACTTCATTCCAGACACCACAAGCCAGATGAGGG
ACTTTACCAATGTGAGGCATCTTTAGGAGATTCTGGCTCAATTATTAGTCG
GACAGCAAAAGTTGCAGTAGCAGGACCACTGAGGTTCCTTTCACAGACA
GAATCTGTCACAGCCTTCATGGGAGACACAGTGCTACTCAAGTGTGAAGT
CATTGGGGAGCCCATGCCAACAATCCACTGGCAGAAGAACCAACAAGAC
CTGACTCCAATCCCAGGTGACTCCCGAGTGGTGGTCTTGCCCTCTGGAGC
ATTGCAGATCAGCCGACTCCAACCGGGGGACATTGGAATTTACCGATGCT
CAGCTCGAAATCCAGCCAGCTCAAGAACAGGAAATGAAGCAGAAGTCAG
AATTTTATCAGATCCAGGACTGCATAGACAGCTGTATTTTCTGCAAAGAC
CATCCAATGTAGTAGCCATTGAAGGAAAAGATGCTGTCCTGGAATGTTGT
GTTTCTGGCTATCCTCCACCAAGTTTTACCTGGTTACGAGGCGAGGAAGT
CATCCAACTCAGGTCTAAAAAGTATTCTTTATTGGGTGGAAGCAACTTGC
TTATCTCCAATGTGACAGATGATGACAGTGGAATGTATACCTGTGTTGTC
ACATATAAAAATGAGAATATTAGTGCCTCTGCAGAGCTCACAGTCTTGGT
TCCGCCATGGTTTTTAAATCATCCTTCCAACCTGTATGCCTATGAAAGCAT
GGATATTGAGTTTGAATGTACAGTCTCTGGAAAGCCTGTGCCCACTGTGA
ATTGGATGAAGAATGGAGATGTGGTCATTCCTAGTGATTATTTTCAGATA
GTGGGAGGAAGCAACTTACGGATACTTGGGGTGGTGAAGTCAGATGAAG
GCTTTTATCAATGTGTGGCTGAAAATGAGGCTGGAAATGCCCAGACCAGT
GCACAGCTCATTGTCCCTAAGCCTGCTATCCCAAGCTCCAGTGTCCTCCCT
TCGGCTCCCAGAGATGTGGTCCCTGTCTTGGTTTCCAGCCGATTTGTCCGT
CTCAGCTGGCGCCCACCTGCAGAAGCGAAAGGGAACATTCAAACTTTCAC
GGTCTTTTTCTCCAGAGAAGGTGACAACAGGGAACGAGCATTGAATACA
ACACAGCCTGGGTCCCTTCAGCTCACTGTGGGAAACCTGAAGCAGAAGC
CATGTACACCTTTCGAGTTGTGGCTTACAATGAATGGGGACCGGGAGAGA
GTTCTCAACCCATCAAGGTGGCCACACAGCCTGAGTTGCAAGTTCCAGGG
CCAGTAGAAACCTGCAAGCTGTATCTACCTCACCTACCTCAATTCTTATT
ACCTGGGAACCCCCTGCCTATGCAAACGGTCCAGTCCAAGGTTACAGATT
GTTCTGCACTGAGGTGTCCACAGGAAAAGAACAGAATATAGAGGTTGAT
GGACTATCTTATAAACTGGAAGGCCTGAAAAAATTCACCGAATATAGTCT
TCGATTCTTAGCTTATAATCGCTATGGTCCGGGCGTCTCTACTGATGATAT
AACAGTGGTTACACTTTCTGACGTGCCAAGTGCCCCGCCTCAGAACGTCT
CCCTGGAAGTGGTCAATTCAAGAAGTATCAAAGTTAGCTGGCTGCCTCCT
CCATCAGGAACACAAAATGGATTTATTACCGGCTATAAAATTCGACACAG
AAAGACGACCCGCAGGGGTGAGATGAAACACTGGAGCCAAACAACCTC
TGGTACCTATTCACAGGACTGGAGAAAGGAAGTCAGTACAGTTTCCAGGT
GTCAGCCATGACAGTCAATGGTACTGGACCACCTTCCAACTGGTATACTG
CAGAGACTCCAGAGAATGATCTAGATGAATCTCAAGTTCCTGATCAACCA
AGCTCTCTTCATGTGAGGCCCCAGACTAACTGCATCATCATGAGTTGGAC
TCCTCCCTTGAACCCAAACATCGTGGTGCGAGGTTATATTATCGGTTATG
GCGTTGGGAGCCCTTACGCTGAGACAGTGCGTGTGGACAGCAAGCAGCG
ATATTATTCCATTGAGAGGTTAGAGTCAAGTTCCCATTATGTAATCTCCCT
AAAAGCTTTTAACAATGCCGGAGAAGGAGTTCCTCTTTATGAAAGTGCCA
CCACCAGGTCTATAACCGATCCCACTGACCCAGTTGATTATTATCCTTTGC
TTGATGATTTCCCCACCTCGGTCCCAGATCTCTCCACCCCCATGCTCCCAC
CAGTAGGTGTACAGGCTGTGGCTCTTACCCATGATGCTGTGAGGGTCAGC
TGGGCAGACAACTCTGTCCCTAAGAACCAAAAGACGTCTGAGGTGCGAC
TTTACACCGTCCGGTGGAGAACCAGCTTTTCTGCAAGTGCAAAATACAAG
TCAGAAGACACAACATCTCTAAGTTACACAGCAACAGGCCTCAAACCAA
ACACAATGTATGAATTCTCGGTCATGGTAACAAAAAACAGAAGGTCCAG
TACTTGGAGCATGACTGCACATGCCACCACGTATGAAGCAGCCCCCACCT
CTGCTCCCAAGGACTTGACAGTCATTACTAGGGAAGGGAAGCCTCGTGCC
GTCATTGTGAGTTGGCAGCCTCCCTTGGAAGCCAATGGGAAATTACTGC
TTACATCTTATTTTACCTTGGACAAGAACATCCCAATTGATGACTGGAT
TATGGAAACAATCAGTGGTGATAGGCTTACTCATCAAATCATGGATCTCA
ACCTTGATACTATGTATTACTTTCGAATTCAAGCACGAAATTCAAAAGGA
GTGGGGCCACTCTCTGATCCTATCCTCTTCAGGACTCTGAAAGTGGAACA
CCCTGACAAAATGGCTAATGACCAAGGTCGTCATGGAGATGGAGGTTATT
GGCCAGTTGATACTAATTTGATTGATAGAAGCACCCTAAATGAGCCGCCA
ATTGGACAAATGCACCCCCCGCATGGCAGTGTCACTCCTCAGAAGAACAG | |

TABLE B-continued

| Gene Fusion | Chimera Sequence | SEQ ID NO. |
|---|---|---|
| | CAACCTGCTTGTGATCATTGTGGTCACCGTTGGTGTCATCACAGTGCTGGT AGTGGTCATCGTGGCTGTGATTTGCACCCGACGCTCTTCAGCCCAGCAGA GAAAGAAACGGGCCACCCACAGTGCTGGCAAAAGGAAGGGCAGCCAGA AGGACCTCCGACCCCCTGATCTTTGGATCCATCATGAAGAAATGGAGATG AAAAATATTGAAAAGCCATCTGGCACTGACCCTGCAGGAAGGGACTCTC CCATCCAAAGTTGCCAAGACCTCACACCAGTCAGCCACAGCCAGTCAGA AACCCAACTGGGAAGCAAAAGCACCTCTCATTCAGGTCAAGACACTGAG GAAGCAGGGAGCTCTATGTCCACTCTGGAGAGGTCGCTGGCTGCACGCCG AGCCCCCCGGGCCAAGCTCATGATTCCCATGGATGCCCAGTCCAACAATC CTGCTGTCGTGAGCGCCATCCCGGTGCCAACGCTAGAAAGTGCCCAGTAC CCAGGAATCCTCCCGTCTCCCACCTGTGGATATCCCCACCCGCAGTTCACT CTCCGGCCTGTGCCATTCCCAACACTCTCAGTGGACCGAGGTTTCGGAGC AGGAAGAAGTCAGTCAGTGAGTGAAGGACCAACTACCCAACAACCACCT ATGCTGCCCCCATCTCAGCCTGAGCATTCTAGCAGCGAGGAGGCACCAAG CAGAACCATCCCCACAGCTTGTGTTCGACCAACTCACCCACTCCGCAGCT TTGCTAATCCTTTGCTACCTCCACCAATGAGTGCAATAGAACCGAAAGTC CCTTACACACCACTTTTGTCTCAGCCAGGGCCCACTCTTCCTAAGACCCAT GTGAAAACAGCCTCCCTTGGGTTGGCTGGAAAAGCAAGATCCCCTTTGCT TCCTGTGTCTGTGCCAACAGCCCCTGAAGTGTCTGAGGAGAGCCACAAAC CAACAGAGGATTCAGCCAATGTGTATGAACAGGATGATCTGAGTGAACA AATGGCAAGTTTGGAAGGACTCATGAAGCAGCTTAATGCCATCACAGGCT CAGCCTTTTAA | |
| KIF16B-> PCSK2 | ATGGCATCGGTCAAGGTGGCCGTGAGGGTCCGGCCCATGAATCGCAGCTT CCCTTTGCTGAAGGTCTGTACCACTTTTATCACAATGGCCTTGCAAAGGCC AAGAGAAGACGCAGCCTACACCACAAGCAGCAGCTGGAGAGAGACCCCA GGGTAAAGATGGCTTTGCAGCAGGAAGGATTTGACCGAAAAAGCGAGG TTACAGAGACATCAATGAGATCGACATCAACATGAACGATCCTCTTTTTA CAAAGCAGTGGTATCTGATCAATACTGGGCAAGCTGATGGCACTCCTGGC CTTGATTTGAATGTGGCTGAAGCCTGGGAGCTGGGATACACAGGGAAAG GTGTTACCATTGGAATTATGGATGATGGGATTGACTATCTCCACCCGGAC CTGGCCTCCAACTATAATGCCGAAGCAAGTTACGACTTCAGCAGCAACGA CCCCTATCCTTACCCTCGGTACACAGATGACTGGTTTAACAGCCACGGGA CCCGATGTGCAGGAGAAGTTTCTGCTGCCGCCAACAACAATATCTGTGGA GTTGGAGTAGCATACAACTCCAAGGTTGCAGGCATCCGGATGCTGGACCA GCCATTCATGACAGACATCATCGAGGCCTCCTCCATCAGTCATATGCCAC AGCTGATTGACATCTACAGCGCCAGCTGGGGCCCCACAGACAACGGCAA GACAGTGGATGGGCCCGGGAGCTCACGCTGCAGGCCATGGCCGATGGC GTGAACAAGGGCCGCGGCGGCAAAGGCAGCATCTACGTGTGGGCCTCCG GGGACGGCGGCAGCTATGACGACTGCAACTGCGACGGCTACGCCTCCAG CATGTGGACCATCTCCATCAACTCAGCCATCAACGACGGCAGGACTGCCC TGTACGACGAGAGCTGCTCTTCCACCCTTGGCTTCCACCTTCAGCAACGGG AGGAAAAGGAACCCCGAGGCCGGTGTGGCAACCACAGATTTGTACGGCA ACTGCACTCTGAGGCATTCTGGGACATCTGCAGCTGCCCCCGAGGCAGCT GGTGTGTTTGCACTGGCTCTGGAGGCTAACCTGGGTCTGACCTGCGGGA CATGCAGCATCTGACTGTGCTCACCTCCAAACGGAACCAGCTTCACGACG AGGTCCATCAGTGGCGGCGCAATGGGGTCGGCCTGGAATTTAATCACCTC TTTGGCTACGGGGTCCTTGATGCAGGTGCCATGGTGAAAATGGCTAAAGA CTGGAAAACCGTGCCTGAGAGATTCCACTGTGTGGGAGGCTCCGTGCAGG ACCCTGAGAAAATACCATCCACTGGCAAGTTGGTGCTGACACTCACAACC GACGCCTGTGAGGGGAAGGAAAATTTTGTCCGCTACCTGGAGCATGTCCA GGCTGTCATCACGGTCAACGCAACCAGAAGAGGAGACCTGAACATCAAC ATGACTTCCCCTATGGGCACCAAGTCCATTTTGCTGAGCCGGCGTCCAAG GGATGACGACTCCAAGGTGGGCTTTGACAAGTGGCCTTTCATGACCACTC ACACGTGGGGGAAGACGCCCGAGGCACCTGGACCCTGGAGCTGGGATT TGTCGGCAGCGCCCCGCAGAAGGGGGTGCTGAAGGAGTGGACCCTGATG CTGCATGGCACTCAGAGTGCCCCGTACATCGACCAGGTGGTGCGGGATTA CCAGTCCAAGTTGGCCATGTCCAAGAAAGAGGAGCTGGAGGAAGAGCTG GACGAAGCCGTGGAGAGAAGCCTGAAAAGCATCCTTAACAAGAACTAG | SEQ ID NO: 36 |
| ACSL3-> MOGAT1 | GTCCCAGGCGGTTCCGCTCAACAGACGCTGCTGTGGCTGCGCCGGGCTGC GACACTGCAGTTGTCTACGCGGCCGGGGCCGGGACGAGGAGGCGTTGGA CGGGGTCGCATACGTTCGTCCCCTCGCATTGCGGCCCCGACAGCTGCGCC AGGATCCCGGGCGGCGGCGCGGGGCGTGAACGCTCTGGGGCTCAGCCA GGCCTGCGCGGGCCCGAGGCCGGAGGAACCCGGACTCCGGCGTAGCGGG CCGATGTCCATTGGAATCACTGTGATGCTGATCATACACAACTATTTGTTC CTTTACATCCCTTATTTGATGTGGCTTTACTTTGACTGGCATACCCCAGAG CGAGGAGGCAGGAGATCCAGCTGGATCAAAAATTGGACTCTTTGGAAAC ACTTTAAGGACTATTTTCCAATTCATCTTATCAAAACTCAAGATTTGGATC CAAGTCACAACTATATATTTGGGTTTCACCCCCATGGAATAATGGCAGTT GGAGCCTTTGGGAATTTTTCTGTAAATTATTCTGACTTCAAGGACCTGTTT CCTGGCTTTACTTCATATCTTCACGTGCTGCCACTTTGGTTCTGGTGTCCT GTCTTTCGAGAATATGTGATGAGTGTTGGGCTGGTTTCAGTTTCCAAGAA AAGTGTGTCCTACATGGTAAGCAAGGAGGGAGGTGGAAACATCTCTGTC ATTGTCCTTGGGGGTGCAAAAGAATCACTGGATGCTCATCCTGGAAAGTT CACTCTGTTCATCCGCCAGCGGAAAGGATTTGTTAAAATTGCTTTGACCC ATGGCGCCTCTCTGGTCCCAGTGGTTTCTTTTGGTGAAAATGAACTGTTTA | SEQ ID NO: 37 |

TABLE B-continued

| Gene Fusion | Chimera Sequence | SEQ ID NO. |
|---|---|---|
| | AACAAACTGACAACCCTGAAGGATCATGGATTAGAACTGTTCAGAATAA ACTGCAGAAGATCATGGGGTTTGCTTTGCCCCTGTTTCATGCCAGGGGAG TTTTTCAGTACAATTTTGGCCTAATGACCTATAGGAAAGCCATCCACACT GTTGTTGGCCGCCCGATCCCTGTTCGTCAGACTCTGAACCCGACCCAGGA GCAGATTGAGGAGTTACATCAGACCTATATGGAGGAACTTAGGAAATTGT TTGAGGAACACAAAGGAAAGTATGGCATTCCAGAGCACGAGACTCTTGT TTTAAAATGACTTGACTATAAAAAAAAATTAAAAAATAAAAATAAATGA CT | |
| DLG5->ADK | ATGGAGCCCCAGCGCCGGGAGCTGCTCGCCCAGTGTCAGCAGAGCCTGG CCCAGGCCATGACGGAGGTGGAAGCCGTGCTCGGGCTGCTCGAGGCCGC GGGAGCGCTCAGTCCCGGCGAGCGGCGGCAGCTGGACGAGGAGGCGGGA GGCGCCAAGGCGGAGCTGCTGCTCAAGCTGCTCTTGGCCAAGGAGCGGG ACCACTTCCAGGACCTGCGGGCGGCGCTGGAGAAGACGCAGCCTCACCT GCTGCCCATTCTCTACCTGAACGGCGTCGTCGGGCCGCCGCAGCCCGCCG AAGGCGCGGGTTCTACCTACAGCGTCCTGTCCACCATGCCCTCAGACTCA GAAAGCAGCAGCTCCCTCAGCAGTGTGGGCACTACCGGGAAGGCGCCGT CCCCACCACCCCTCCTCACTGACCAGCAAGTGAATGAGAAGGTGGAGAA CCTCTCCATTCAGCTGCGGCTGATGACCCGGGAGAGAAACGAGCTCCGCA AGCGCCTGGCCTTTGCTACGCATGGCACGGCCTTTGACAAGAGGCCCTAC CACAGGCTGAATCCTGACTATGAGAGGCTGAAGATCCAGTGCGTGCGAG CCATGTCGGACCTGCAGAGCCTGCAGAACCAGCACACCAACGCCTTGAA GAGGTGTGAGGAGGTGGCCAAGGAGACTGACTTCTACCACACACTCCAC AGCCGGCTCCTGAGTGACCAGACTCGGCTGAAGGATGACGTGGACATGC TGAGGCGGGAGAATGGGCAGCTGCTGCGGGAGCGAAACCTGCTGCAGCA GTCATGGGAGGACATGAAGCGGCTCCACGAGGAGGACCAGAAGGAGATC GGTGACCTCCGTGCCCAGCAGCAGCAGTGGATGATTCAACAGCCACACA AAGCAGCAACATTTTTTGGATGCATTGGGATAGATAAATTTGGGGAGATC CTGAAGAGAAAAGCTGCTGAAGCCCATGTGGATGCTCATTACTACGAGC AGAATGAGCAGCCAACAGGAACTTGTGCTGCATGCATCACTGGTGACAA CAGGTCCCTCATAGCTAATCTTGCTGCTGCCAATTGTTATAAAAAGGAAA ACATCTTGATCTGGAGAAAAACTGGATGTTGGTAGAAAAAGCAAGAGT TTGTTATATAGCAGGCTTTTTTCTTACAGTTTCCCCAGAGTCAGTATTAAA GGTGGCTCACCATGCTTCTGAAAACAACAGGATTTTCACTTTGAATCTAT CTGCACCGTTTATTAGCCAGTTCTACAAGGAATCATTGATGAAAGTTATG CCTTATGTTGATATACTTTTTGGAAATGAGACAGAAGCTGCCACTTTTGCT AGAGAGCAAGGCTTTGAGACTAAAGACATTAAAGAGATAGCCAAAAGA CACAAGCCCTGCCAAAGATGAACTCAAAGAGGCAGCGAATCGTGATCTT CACCCAAGGGAGAGATGACACTATAATGGCTACAGAAAGTGAAGTCACT GCTTTTGCTGTCTTGGATCAAGACCAGAAAGAAATTATTGATACCAATGG AGCTGGAGATGCATTTGTTGGAGGTTTTCTGTCTCAACTGGTCTCTGACAA GCCTCTGACTGAATGTATCCGTGCTGGCCACTATGCAGCAAGCATCATAA TTAGACGGACTGGCTGCACCTTTCCTGAGAAGCCAGACTTCCACTGA | SEQ ID NO: 38 |
| VDAC3->IL1RAPL1 | ATGTGTAACACACCAACGTACTGTGACCTAGGAAAGGCTGCTAAGGATGT CTTCAACAAAGGATATGGCTTTGGCATGGTCAAGATAGACCTGAAAACCA AGTCTTGTAGTGGAGTGGAATTTTCTACTTCTGGTCATGCTTACACTGATA CAGGGAAAGCATCAGGCAACCTAGAAACCAAATATAAGGTCTGTAACTA TGGACTTACCTTCACCCAGAAATGGAACACAGACAATACTCTAGGGACA GAAATCTCTTGGGAGAATAAGCCGATGGATGCACTGACTGGTCTATCGAT ATCAAGAAATATCAAGTTTTGGTGGGAGAGCCTGTTCGAATCAAATGTGC ACTCTTTTATGGTTATATCAGAACAAATTACTCCCTTGCCCAAAGTGCTGG ACTCAGTTTGATGTGGTACAAAAGTTCTGGTCCTGGAGACTTTGAAGAGC CAATAGCCTTTGACGAAGTAGAATGAGCAAAGAAGAAGACTCCATTTG GTTCCGGCCAACATTGCTACAGGACAGTGGTCTCTACGCCTGTGTCATCA GAAACTCCACTTACTGTATGAAAGTATCCATCTCACTGACAGTGGGTGAA AATGACACTGGACTCTGCTATAATTCCAAGATGAAGTATTTTGAAAAAGC TGAACTTAGCAAAAGCAAGGAAATTTCATGCCGTGACATAGAGGATTTTC TACTGCCAACCAGAGAACCTGAAATCCTTTGGTACAAGGAATGCAGGAC AAAAACATGGAGGCCAAGTATTGTATTCAAAAGAGATACTCTGCTTATAA GAGAAGTCAGAGAAGATGACATTGGAAATTATACCTGTGAATTAAAATA TGGAGGCTTTGTTGTGAGAAGAACTACTGAATTAACTGTTACAGCCCCTC TGACTGATAAGCCACCCAAGCTTTTGTATCCTATGGAAAGTAAACTGACA ATTCAGGAGACCCAGCTGGGTGACTCTGCTAATCTAACCTGCAGAGCTTT CTTTGGGTACAGCGGAGATGTCAGTCCTTTAATTTACTGGATGAAAGGAG AAAAATTTATTGAAGATCTGGATGAAATCGAGTTTGGGAAAGTGACATT AGAATTCTTAAGGAGCATCTTGGGAACAGGAAGTTTCCATCTCATTAAT GTGGACTCTGTGGAAGAAGGTGACTTGGGAAATTACTCCTGTTATGTTG AAAATGGAAATGGACGTCGACACGCCAGCGTTCTCCTTCATAAACGAGA GCTAATGTACACAGTGGAACTTGCTGGAGGCCTTGGTGCATACTCTTGC TGCTTGTATGTTTGGTGACCATCTACAAGTGTTACAAGATAGAAATCATG CTCTTCTACAGGAATCATTTTGGAGCTGAAGAGCTCGATGGAGACAATAA AGATTATGATGCATACTTATCATACACCAAAGTGGATCCTGACCAGTGGA ATCAAGAGACTGGGGAAGAAGAACGTTTGCCCTTGAAATCCTACCTGAT ATGCTTGAAAAGCATTATGGATATAAGTTGTTTATACCAGATAGAGATTT AATCCCAACTGGAACATACATTGAAGATGTGGCAAGATGTGTAGATCAA AGCAAGCGGCTGATTATTGTCATGACCCCAAATTACGTAGTTAGAAGGGG | SEQ ID NO: 39 |

TABLE B-continued

| Gene Fusion | Chimera Sequence | SEQ ID NO. |
|---|---|---|
| | CTGGAGCATCTTTGAGCTGGAAACCAGACTTCGAAATATGCTTGTGACTG GAGAAATTAAAGTGATTCTAATTGAATGCAGTGAACTGAGAGGAATTAT GAACTACCAGGAGGTGGAGGCCCTGAAGCACACCATCAAGCTCCTGACG GTCATTAAATGGCATGGACCAAAATGCAACAAGTTGAACTCCAAGTTCTG GAAACGTTTACAGTATGAAATGCCTTTTAAGAGGATAGAACCCATTACAC ATGAGCAGGCTTTAGATGTCAGTGAGCAAGGGCCTTTTGGGGAGCTGCAG ACTGTCTCGGCCATTTCCATGGCCGCGGCCACCTCCACAGCTCTAGCCAC TGCCCATCCAGATCTCCGTTCTACCTTTCACAACACGTACCATTCACAAAT GCGTCAGAAACACTACTACCGAAGCTATGAGTACGACGTACCTCCTACCG GCACCCTGCCTCTTACCTCCATAGGCAATCAGCATACCTACTGTAACATC CCTATGACACTCATCAACGGGCAGCGGCCACAGACAAAATCGAGCAGGG AGCAGAATCCAGATGAGGCCCACACAAACAGTGCCATCCTGCCGCTGTTG CCAAGGGAGACCAGTATATCCAGTGTGATATGGTGA | |
| ERBB2-> IKZF3 | ATGGAGCTGGCGGCCTTGTGCCGCTGGGGGCTCCTCCTCGCCCTCTTGCC CCCCGGAGCCGCGAGCACCCAAGTGTGCACCGGCACAGACATGAAGCTG CGGCTCCCTGCCAGTCCCGAGACCCACCTGGACATGCTCCGCCACCTCTA CCAGGGCTGCCAGGTGGTGCAGGGAAACCTGGAACTCACCTACCTGCCC ACCAATGCCAGCCTGTCCTTCCTGCAGGATATCCAGGAGGTGCAGGGCTA CGTGCTCATCGCTCACAACCAAGTGAGGCAGGTCCCACTGCAGAGGCTGC GGATTGTGCGAGGCACCCAGCTCTTTGAGGACAACTATGCCCTGGCCGTG CTAGACAATGGAGACCCGCTGAACAATACCACCCCTGTCACAGGGGCCTC CCCAGGAGGCCTGCGGGAGCTGCAGCTTCGAAGCCTCACAGAGATCTTG AAAGGAGGGGTCTTGATCCAGCGGAACCCCCAGCTCTGCTACCAGGACA CGATTTTGTGGAAGGACATCTTCCACAAGAACAACCAGCTGGCTCTCACA CTGATAGACACCAACCGCTCTCGGGCCTGCCACCCCTGTTCTCCGATGTG TAAGGGCTCCCGCTGCTGGGGAGAGAGTTCTGAGGATTGTCAGAGCCATG ATTCAATGAAAGTGAAAGATGAATACAGTGAAAGAGATGAGAATGTTTT AAAGTCAGAACCCATGGGAAATGCAGAAGAGCCTGAAATCCCTTACAGC TATTCAAGAGAATATAATGAATATGAAAACATTAAGTTGGAAAGACATG TTGTCTCATTCGATAGTAGCAGGCCAACCAGTGGAAAGATGAACTGCGAT GTGTGTGGATTATCCTGCATCAGCTTCAATGTCTTAATGGTTCATAAGCGA AGCCATACTGGTGAACGCCCATTCCAGTGTAATCAGTGTGGGGCATCTTT TACTCAGAAAGGTAACCTCCTCCGCCACATTAAACTGCACACAGGGGAA AAACCTTTTAAGTGTCACCTCTGCAACTATGCATGCAAAGAAGAGATGC GCTCACGGGGCATCTTAGGACACATTCTGTGGAGAAACCCTACAAATGTG AGTTTTGTGGAAGGAGTTACAAGCAGAGAAGTTCCCTTGAGGAGCACAA GGAGCGCTGCCGTACATTTCTTCAGAGCACTGACCCAGGGGACACTGCAA GTGCGGAGGCAAGACACATCAAAGCAGAGATGGAAGTGAAAGAGCTCT CGTACTGGACAGATTAGCAAGCAATGTGGCAAAACGAAAAAGCTCAATG CCTCAGAAATTCATTGGTGAGAAGCGCCACTGCTTTGATGTCAACTATAA TTCAAGTTACATGTATGAGAAAGAGAGTGAGCTCATACAGACCCGCATG ATGGACCAAGCCATCAATAACGCCATCAGCTATCTTGGCGCCGAAGCCCT GCGCCCCTTGGTCCAGACACCGCCTGCTCCCACCTCGGAGATGGTTCCAG TTATCAGCAGCATGTATCCCATAGCCCTCACCCGGGCTGAGATGTCAAAC GGTGCCCCTCAAGAGCTGGAAAAGAAAAGCATCCACCTTCCAGAGAAGA GCGTGCCTTCTGAGAGGCCTCTCTCCCAACAATAGTGGCCACGACTCC ACGGACACTGACAGCAACCATGAAGAACGCCAGAATACACATCTATCAGC AAAATCACATGGTCCTGTCTCGGGCCCGCAATGGGATGCCACTTCTGAAG GAGGTTCCCCGCTCTTACGAACTCCTCAAGCCCCGCCCATCTGCCCAAG AGACTCCGTCAAAGTGATCAACAAGGAAGGGGAGGTGATGGATGTGTAT CGGTGTGACCACTGCCGCGTCCTCTTCCTGGACTATGTGATGTTCACGATT CACATGGGCTGCCACGGCTTCCGTGACCCTTTCGAGTGTAACATGTGTGG ATATCGAAGCCATGATCGGTATGAGTTCTCGTCTCACATAGCCAGAGGAG AACACAGAGCCCTGCTGAAGTGA | SEQ ID NO: 40 |
| ERBB2-> IKZF3 | ATGGAGCTGGCGGCCTTGTGCCGCTGGGGGCTCCTCCTCGCCCTCTTGCC CCCCGGAGCCGCGAGCACCCAAGTGTGCACCGGCACAGACATGAAGCTG CGGCTCCCTGCCAGTCCCGAGACCCACCTGGACATGCTCCGCCACCTCTA CCAGGGCTGCCAGGTGGTGCAGGGAAACCTGGAACTCACCTACCTGCCC ACCAATGCCAGCCTGTCCTTCCTGCAGGATATCCAGGAGGTGCAGGGCTA CGTGCTCATCGCTCACAACCAAGTGAGGCAGGTCCCACTGCAGAGGCTGC GGATTGTGCGAGGCACCCAGCTCTTTGAGGACAACTATGCCCTGGCCGTG CTAGACAATGGAGACCCGCTGAACAATACCACCCCTGTCACAGGGGCCTC CCCAGGAGGCCTGCGGGAGCTGCAGCTTCGAAGCCTCACAGAGATCTTG AAAGGAGGGGTCTTGATCCAGCGGAACCCCCAGCTCTGCTACCAGGACA CGATTTTGTGGAAGGACATCTTCCACAAGAACAACCAGCTGGCTCTCACA CTGATAGACACCAACCGCTCTCGGGCCTGCCACCCCTGTTCTCCGATGTG TAAGGGCTCCCGCTGCTGGGGAGAGAGTTCTGAGGATTGTCAGAGCCTGA CGCGCACTGTCTGTGCCGGTGGCTGTGCCCGCTGCAAGGGGCCACTGCCC ACTGACTGCTGCCATGAGCAGTGTGCTGCCGGCTGCACGGGCCCCAAGCA CTCTGACTGCCTGGCCTGCCTCCACTTCAACCACAGTGGCATCTGTGAGCT GCACTGCCCAGCCCTGGTCACCTACAACACAGACACGTTTGAGTCCATGC CCAATCCCGAGGGCCGGTATACATTCGGCGCCAGCTGTGTGACTGCCTGT CCCTACAACTACCTTTCTACGGACGTGGGATCCTGCACCCTCGTCTGCCCC CTGCACAACCAAGAGGTGACAGCAGAGGATGGAACACAGCGGTGTGAGA AGTGCAGCAAGCCCTGTGCCCGAGATGATTCAATGAAAGTGAAAGATGA | SEQ ID NO: 41 |

TABLE B-continued

| Gene Fusion | Chimera Sequence | SEQ ID NO. |
|---|---|---|
| | ATACAGTGAAAGAGATGAGAATGTTTTAAAGTCAGAACCCATGGGAAAT GCAGAAGAGCCTGAAATCCCTTACAGCTATTCAAGAGAATATAATGAAT ATGAAAACATTAAGTTGGAGAGACATGTTGTCTCATTCGATAGTAGCAGG CCAACCAGTGGAAAGATGAACTGCGATGTGTGTGGATTATCCTGCATCAG CTTCAATGTCTTAATGGTTCATAAGCGAAGCCATACTGGTGAACGCCCAT TCCAGTGTAATCAGTGTGGGCATCTTTTACTCAGAAAGGTAACCTCCTC CGCCACATTAAACTGCACACAGGGGAAAAACCTTTTAAGTGTCACCTCTG CAACTATGCATGCCAAAGAAGAGATGCGCTCACGGGGCATCTTAGGACA CATTCTGTGGAGAAACCCTACAAATGTGAGTTTTGTGGAAGGAGTTACAA GCAGAAGTTCCCTTGAGGAGCACAAGGAGCGCTGCCGTACATTTCTTC AGAGCACTGACCCAGGGGACACTGCAAGTGCGGAGGCAAGACACATCAA AGCAGAGATGGGAAGTGAAAGAGCTCTCGTACTGGACAGATTAGCAAGC AATGTGGCAAAACGAAAAAGCTCAATGCCTCAGAAATTCATTGGTGAGA AGCGCCACTGCTTTGATGTCAACTATAATTCAAGTTACATGTATGAGAAA GAGAGTGAGCTCATACAGACCCGCATGATGGACCAAGCCATCAATAACG CCATCAGCTATCTTGGCGCCGAAGCCCTGCGCCCCTTGGTCCAGACACCG CCTGCTCCCACCTCGGAGATGGTTCCAGTTATCAGCAGCATGTATCCCAT AGCCCTCACCCGGGCTGAGATGTCAAACGGTGCCCCTCAAGAGCTGGAA AAGAAAAAGCATCCACCTTCCAGAGAAGAGCGTGCCTTCTGAGAGAGGCC TCTCTCCCAACAATAGTGGCCACGACTCCACGGACACTGACAGCAACCAT GAAGAACGCCAGAATCACATCTATCAGCAAAATCACATGGTCCTGTCTCG GGCCCGCAATGGGATGCCACTTCTGAAGGAGGTTCCCCGCTCTTACGAAC TCCTCAAGCCCCCGCCCATCTGCCCAAGAGACTCCGTCAAAGTGATCAAC AAGGAAGGGGAGGTGATGGATGTGTATCGGTGTGACCACTGCCGCGTCC TCTTCCTGGACTATGTGATGTTCACGATTCACATGGGCTGCCACGGCTTCC GTGACCCTTTCGAGTGTAACATGTGTGGATATCGAAGCCATGATCGGTAT GAGTTCTCGTCTCACATAGCCAGAGGAGAACACAGAGCCCTGCTGAAGT GA | |
| EIF4A3-> TSPEAR | ATGGCGACCACGCCACGATGGCGACCTCGGGCTCGGCGCGAAAGCGGC TGCTCAAAGAGGAAGACATGACTAAAGTGGAATTCGAGACCAGCGAGGA GGTGGATGTGACCCCCACGTTCGACACCATGGGCCTGCGGGAGGACCTGC TGCGGGGCATCTACGCTTACGGAGAACGAGTACCTGCTGACGGTGGTGGC AGAGGAGAGCGACCTGCTGCTGCTCGGCCTGCGGTTGTCACCTGCCCAGC TGCACTTCCTGTTCCTTCGCGAGGACACGGCCGGCGCCTGGCACACCCGA GTGTCCTTCCGCAGCCCGGCCCTGGTGGATGGCCGCTGGCACACACTGGT CCTGGCTGTGTCCGCAGGCGTCTTCTCCCTCACCACGGACTGCGGCCTCCC GGTGGACATAATGGCCGATGTGCCCTTCCCAGCCACCCTGTCAGTGAAAG GAGCTCGATTCTTCGTCGGCAGCCGGAGGAGAGCCAAAGGCCTGTTCATG GGACTGGTGAGGCAACTGGTCCTGCTGCCGGGCTCAGACGCCACCCCAA GGCTGTGTCCCAGCAGGAACGCCCCGCTGGCGGTGCTGTCCATCCCACGG GTCCTGCAGGCTCTCACGGGGAAGCCAGAAGATAACGAGGTGCTAAAAT ATCCCTATGAAACCAACATTCGAGTGACGCTGGGACCCCAGCCACCGTGT ACCGAGGTGGAAGACGCCCAGTTCTGGTTTGATGCCAGCCGGAAGGGCC TGTATCTGTGTGTTGGCAACGAGTGGGTCTCCGTGTTAGCAGCCAAAGAA AGACTGGACTACGTGGAGGAGCATCAGAACTTGTCCACCAACTCAGAGA CCCTGGGCATTGAGGTGTTCCGCATCCCTCAGGTGGGGCTCTTTGTGGCC ACAGCCAATCGCAAAGCCACATCCGCCGTCTACAAGTGGACCGAAGAGA AGTTCGTCTCATATCAGAACATCCCCACGCACCAAGCACAGGCCTGGAGG CATTTCACCATCGGGAAAAAGATCTTCCTGGCAGTGGCTAATTTTGAACC AGATGAGAAGGGTCAGGAGTTCTCTGTCATTTACAAATGGAGCCACAGA AAGCTGAAGTTTACCCCATATCAGAGCATTGCCACACACAGCGCCCGAGA CTGGGAGGCCTTCGAGGTGGATGGGAGCACTTCCTGGCGGTGGCCAAC CACCGGGAAGGCGACAACCACAACATCGACAGTGTCATCTACAAGTGGA ACCCGGCAACCCGGCTCTTCGAGGCCAACCAGACCATCGCCACCTCCGGC GCCTACGACTGGGAGTTCTTCAGTGTGGGGCCCTACTCGTTCCTGGTGGT GGCCAACACCTTCAACGGCACCTCCACCAAGGTGCACTCGCACCTCTACA TCCGACTCCTGGGCTCCTTCCAGCTCTTCCAGTCCTTCCCGACGTTCGGTG CTGCAGACTGGGAGGTCTTCCAGATCGGGGAGAGGATCTTCCTCGCTGTG GCAAACAGTCACGCTACGATGTGGAGATGCAAGTCCAGAATGATTCCT ATGTCATCAACTCCGTCATCTACGAGCTGAACGTGACCGCGCAGGCCTTT GTCAAGTTCCAGGACATTCTCACCTGCAGTGCTCTGGACTGGGAGTTTTTC TCGGTGGGAGAAGATTATTTCCTGGTGGTGGCCAACTCCTTCGATGGGCG TACCTTCTCGGTGAACAGTATTTTTACAGGTGGCAGGGCTACGAGGGCT TCGTGGCGGTGCACAGCCTCCCCACCGTCGGCTGCAGGGACTGGGAGGCC TTCAGCACCACGGCTGGTGCCTACCTCATCTACTCCAGCGCCAAGGAGCC CCTCTCCAGGGTCCTGCGGCTGAGGACACGCTGA | SEQ ID NO: 42 |
| BCL7A-> C12orf42 | ATGTCGGGCAGGTCGGTTCGAGCCGAGACGAGGAGCCGGGCCAAAGATG ATATCAAGAGGGTCATGGCGGCGATCGAGAAAGTGCGCAAATGGGAGAA GAAATGGGTGACCGTTGGTGACACATCCCTACGAATCTACAAATGGGTCC CTGTGACGGAGCCCAAGGTTGATGACAAAAACAAGAATAAGAAAAAGG CAAGGACGAGAAGTGTGGCTCAGAGGTGACCACTCCGGAGAACAGTTCC TCCCCAGGGATGATGGACATGCATGATGTCTACAGTGATATGTATGAAAC AAAGGGAAGAAGAATTCTTGCTAACCATCAGACCTTTTGCAAACAGGAT GCAGAAATCCCCTTGCTATATTCCCATTGTGAGCAGTGCCACCCTGTGGG ATAGAAGCACACCCAGTGCAAAGCACATCCCTTGTTATGAAAGAACTTCA | SEQ ID NO: 43 |

TABLE B-continued

| Gene Fusion | Chimera Sequence | SEQ ID NO. |
|---|---|---|
| | GTACCCTGCTCCAGATTCATTAATCACATGAAGAATTTCTCTGAATCTCCT<br>AAATTTCGTAGTCTACACTTTCTGAATTTTCCAGTATTTCCAGAAAGGACT<br>CAAAATTCAATGGCGTGTAAAAGACTACTTCATACTTGCCAGTACATAGT<br>CCCCAGGTGTTCTGTAAGCACAGTTTCTTTTGATGAAGAAAGCTATGAAG<br>AATTCCGTTCCTCTCCAGCACCATCCAGTGAAACTGATGAGGCCCCATTG<br>ATTTTTACTGCCAGAGGAGAAACTGAGGAGAGAGCCAGAGGAGCACCCA<br>AGCAGGCTTGGAACAGTTCATTTTTGGAACAACTGGTTAAAAAGCCTAAC<br>TGGGCACACTCAGTAAATCCTGTTCACCTGGAGGCTCAGGGCATACACAT<br>CAGTAGACACACAAGACCTAAGGGCCAGCCCTTGAGCAGTCCCAAGAAA<br>AATTCTGGTTCTGCCGCCAGACCTTCCACTGCCATCGGCCTCTGCAGGAG<br>GAGCCAGACGCCCGGCGCTCTGCAGAGCACCGGCCCGAGTAACACAGAG<br>CTCGAGCCGGAGGAGAGGATGGCAGTCCCAGCAGGCGCTCAGGCACACC<br>CCGACGACATCCAAAGCAGACTCCTGGGCGCGTCCGGAAATCCCGTCGG<br>AAAAGGCGGGTTGCCATGGCGCCGGAGATGCTCCCCAAGCATCCTCATA<br>CCCCGCGGGACAGGAGGCCTCAGGCGGACACCTCCCTCCATGGCAATCTG<br>GCAGGAGCGCCCCTTCCTCTGCTGGCCGGTGCTTCCACCCATTTCCCCTCC<br>AAGAGGTTAATAAAGGTTTGCTCCTCAGCACCCCCCGCCCAACCCGGCG<br>TTTCCATACGGTTTGTTCACAGGCCCTTTCTAGGCCGGTGGTGAATGCTCA<br>CTTACATTGA | |
| ADK-><br>C10orf11 | ATGACGTCAGTCAGAGAAAATATTCTCTTTGGAATGGGAAATCCTCTGCT<br>TGACATCTCTGCTGTAGTGGACAAAGATTTCCTTGATAAGTATTCTCTGAA<br>ACCAAATGACCAAATCTTGGCTGAAGACAAACACAAGGAACTGTCACTG<br>GAAGGACTGAGCGCATTCAGGAGCCTGGAGGAACTCATCTTGGACAACA<br>ATCAGCTGGGGGACGACCTTGTGTTGCCAGGGTTACCCAGACTGCATACC<br>TTAACCCTCAACAAGAACCGAATCACTGATTTGGAGAACCTGCTGGATCA<br>CTTGGCAGAAGTGACACCAGCTCTGGAGTACCTCAGTCTGCTGGGCAACG<br>TGGCCTGTCCCAACGAGCTGGTCAGCTTGGAAAAGGATGAGGAAGACTA<br>CAAGAGATACAGATGCTTTGTTCTGTACAAGCTGCCCAACTTGAAATTTC<br>TGGATGCCCAGAAAGTAACCAGACAAGAACGAGAGGAGGCGTTGGTCAG<br>AGGAGTCTTCATGAAGGTGGTGAAGCCCAAGGCTTCTAGTGAGGACGTTG<br>CCAGCTCCCCGGAGCGCCACTACACGCCCTTGCCTTCTGCTTCAGGGAA<br>CTCACCAGTCACCAAGGTGTCCTGGGGAAGTGTCGCTACGTTTACTATGG<br>GAAAAACTCAGAGGGCAACAGGTTTATCCGAGATGACCAGCTCTGA | SEQ ID<br>NO: 44 |
| FAM135A<br>-><br>PKIB | GGTGAGAGAGGCCGGGGCGGGGCCGTGCGGCCGGGGACCTGTTGATCG<br>CAGGTATAGCCGGCTGGCCCGGGCTCCCTCGGGACTGGGGCGACTGCGC<br>ATGCTCGCTGGCCGCGCTGGGCCAGTAGCCGAGCCGCGGTGACGAACCG<br>GCTCCGCGGTTGCCGTGTTTGCGGTTGCTGTGATGGCGATGTGAGGGGC<br>CCGGGGCGGGATGGTGCTGACCCGGGTCGGGCCGTCTTCTTGCAGCTGGA<br>CAACGAGCTCCTCGTTGACAGGCGGGGAAGAGGCCGAGCCGGGCGA<br>GAGATGTTGCTATGAGGACAGATTCATCAAAAATGACTGACGTGGAGTCT<br>GGGGTCGCCAATTTTGCATCTTCAGCAAGGGCAGGCCGCCGGAATGCCTT<br>ACCAGACATCCAGAGTTCAGCTGCCACAGACGGAACCTCAGATTTGCCCC<br>TCAAACTGGAGGCTCTCTCCGTGAAGGAAGATGCAAAAGAGAAAGATGA<br>AAAAACAACACAAGACCAATTGGAAAAGCCTCAAATGAAGAAAAATG<br>AAGGCTCATAATCTATCAAGAGTGCTGAATTTCTGCATGTTGAAAGACTT<br>AGTGGTTCTGTTTTCTTGAGACATTTAATCTGGTGGTAACTGTGGTAACAT<br>TGCAGCCCAAGCAGCATGTGTATATTAGATAATTGTGTTGTGATGCTAC<br>TCACTTTGATTGCAATGATGATGTCCAAGGTAAGCTATTAAAAGGCAGGT<br>TACTTCCAAATCGCACTGAAGGAAAAGGTTAAGAATAATACATGATCAC<br>AGAAATGCATACCACTGTCTGTAAACCCAACAAAATTCACTGTTCTCTTTT<br>GGATTTATTTAGCCTGATGTATTTTAATTCAATTTTTATGGTGATGGGCA<br>AATCATTCTTGGTAAATGTAAATCAAACATGATTGATTTAAAACTTCATG<br>GAATTTGTAGAAAATTATGGACATTTTTGGTGAGAAAGAACAATAGTCAA<br>AACTCACATGGATAGAGTGTGTTTGTTTTTTGCCAAAAATGCCCCAGACT<br>TTTTCCCAAACCTCAAAAACGTCTTGGAAAAATTGTAAAGTTTGATAAC<br>AGAAACATCTTTAGGATATTTTGTCTGACATATTTTGCTTCTAGTATGTG<br>CCTACTGTGATTTTTTCATGTGGAAAATGCAAAATTTGTAACAAAATGG<br>TTATATGGAACATGCCTATTAAATGAATTTTACTATCTTCCCTAACTTTGG<br>TCTGTGTATGTGTGTGTGTTTTACTTTAATATGAATTATACAAAATACTAG<br>TTGTTTTACACTCTCTTTTCTTATTCTTAGGGCTTTTGTGTATGTCTGACTT<br>GTTTTTAAATAACTTCCTCAGCAATGCAGACCTTAATTTTATATTTTTTA<br>AAGTAGCTAACATAGCAGTAGGCACTTAAGCATTTAGTCAATGATATTGG<br>TAGAAATAGTAAAATACATCCTTTAAATATATATCTAAGCATATATTTTA<br>AAAGGAGCAAAATAAAACCAAAGTGTTAGTAAATTTTGATTTATTAGAT<br>ATTTTAGAAAATAATAGAATTCTGAAGTTTTAAAAATGTCAGTAATTAA<br>TTTATTTTCATTTTCAGAAATATATGCATGCAGTTATGTTTTATTTGATTGT<br>TGACTTAGGCTATGTCTGTATACAGTAACCAAATAAACTCTTTCACTATTA<br>AAGAGATTCTTACTGAC | SEQ ID<br>NO: 45 |
| CDC42BPB<br>-><br>PET112 | ATGTCGGCCAAGGTGCGGCTCAAGAAGCTGGAGCAGCTGCTCCTGGACG<br>GGCCCTGGCGCAACGAGAGCGCCCTGAGCGTGGAAACGCTGCTCGACGT<br>GCTCGTCTGCCTGTACACCGAGTGCAGCCACTCGGCCCTGCGCCGCGACA<br>AGTACGTGGCCGAGTTCCTCGAGTGGGGTGTTTGAGGAACTGTGGAAGA<br>GGGAAGGCAAGACTCCAGGGCAGATTGTTTCAGAAAAGCAGCTTGAACT<br>GATGCAGGACCAGGGGGCACTGGAGCAGCTCTGCCACTCTGTGATGGAG | SEQ ID<br>NO: 46 |

TABLE B-continued

| Gene Fusion | Chimera Sequence | SEQ ID NO. |
|---|---|---|
| | GCCCATCCTCAAGTGGTAATGGATGTGAAGAACAGAAACCCCAGAGCTA TAAATAAACTGATTGGGTTGGTCCGGAAAGCGACTCAAAGCCGAGCAGA TCCAGTCATGATAAAGGAGATCCTGGAGAAGAAGCTGTCATTGTGA | |
| SAV1-> NIN | ATGCTGTCCCGAAAGAAAACCAAAAACGAAGTGTCCAAGCCGGCCGAGG TGCAGGGGAAGTACGTGAAGAAGGAGACGTCGCCTCTGCTTCGGAATCTT ATGCCTTCATTCATCCGGCATGGTCCAACAATTCCAAGACGAACTGATAT CTGTCTTCCAGATTCAAGCCCTAATGCCTTTTCAACTTCTGGAGATGTAGT TTCAAGAAACCAGAGTTTCCTTAGAACTCCAATTCAAAGAACACCTCATG AAATAATGAGAAGAGAAAGCAACAGATTATCTGCACCTTCTTATCTTGCC AGAAGTCTAGCAGATGTCCCTAGAGAGTATGGTTCTTCTCAGTCATTTGT AACGGAAGTTAGTTTTGCTGTTGAAAATGGAGACTCTGGTTCCCGATATT ATTATTCAGACAATTTTTTTGATGGTCAGAGAAAGCGGCCACTTGGAGAT CGTGCACATGAAGACTACAGATATTATGAATACAACCATGATCTCTTCCA AAGAATGCCACAGAATCAGGGGAGGCATGCTTCAGCACTGGAAGACGCA ACGCAGTGAGGAGTATGAAGCGGAAGGCCAGTTAAGGTTTTGGAACCCA GATGACTTGAATGCTTCACAGAGTGGATCTTCCCCTCCCCAAGACTGGAT AGAAGAGAAACTGCAAGAAGTTTGTGAAGATTTGGGGATCACCCGTGAT GGTCACCTGAACCGGAAGAAGCTGGTCTCCATCTGTGAGCAGTATGGTTT ACAGAATGTGGATGGAGAGATGCTCGAGGAAGTATTCCATAATCTTGATC CTGACGGTACAATGAGTGTAGAAGATTTTTTCTATGGTTTGTTTAAAAAT GGAAAATCTCTTACACCATCAGCATCTACTCCATATAGACAACTAAAAAG GCACCTTTCCATGCAGTCTTTCGATGAGAGTGGACGACGTACCACAACCT CATCAGCAATGACAAGTACCATTGGCTTTCGGGTCTTCTCCTGCCTGGAT GATGGGATGGGCCATGCATCTGTGGAGAGAATACTGGACACCTGGCAGG AAGAGGGCATTGAGAACAGCCAGGAGATCCTGAAGGCCTTGGATTTCAG CCTCGATGGAAACATCAATTTGACAGAATTAACACTGGCCCTTGAAAATG AACTTTTGGTTACCAAGAACAGCATTCACCAGGCGGCTCTGGCCAGCTTT AAGGCTGAAATCCGGCATTTGTTGGAACGAGTTGATCAGGTGGTCAGAG AAAAAGAGAAGCTACGGTCAGATCTGGACAAGGCCGAGAAGCTCAAGTC TTTAATGGCCTCGGAGGTGGATGATCACCATGCGGCCATAGAGCGGCGG AATGAGTACAACCTCAGGAAACTGGATGAAGAGTACAAGGAGCGAATAG CAGCCTTAAAAAATGAACTCCGAAAAGAGAGAGCAGATCCTGCAGCA GGCAGGCAAGCAGCGTTTAGAACTTGAACAGGAAATTGAAAAGGCAAAA ACAGAAGAGAACTATATCCGGGACCGCCTTGCCCTCTCTTTAAAGGAAAA CAGTCGTCTGGAAAATGAGCTTCTAGAAAATGCAGAGAAGTTGGCAGAA TATGAGAATCTGACAAACAAACTTCAGAGAAATTTGGAAAATGTGTTAGC AGAAAAGTTTGGTGACCTCGATCCTAGCAGTGCTGAGTTCTTCCTGCAAG AAGAGAGACTGACACAGATGAGAAATGAATATGAGCGGCAGTGCAGGGT ACTACAAGACCAAGTAGATGAACTCCAGTCTGAGCTGGAAGAATATCGT GCACAAGGCAGAGTGCTCAGGCTTCCGTTGAAGAACTCACCGTCAGAAG AAGTTGAGGCTAACAGCGGTGGCATTGAGCCCGAACACGGGCTCGGTTCT GAAGAATGCAATCCATTGAATATGAGCATTGAGGCAGAGCTGGTCATTG AACAGATGAAAGAACAACATCACAGGGACATATGTTGCCTCAGACTGGA GCTCGAAGATAAAGTGCGCCATTATGAAAAGCAGCTGGACGAAACCGTG GTCAGCTGCAAGAAGGCACAGGAGAACATGAAGCAAAGGCATGAGAAC GAAACGCACACCTTAGAAAAAACAAATAAGTGACCTTAAAAATGAAATTG CTGAACTTCAGGGGCAAGCAGCAGTGCTCAAGGAGGCACATCATGAGGC CACTTGCAGGCATGAGGAGGAGAAAAAACAACTGCAAGTGAAGCTTGAG GAGGAAAAGACTCACCTGCAGGAGAAGCTGAGGCTGCAACATGAGATGG AGCTCAAGGCTAGACTGACACAGGCTCAAGCAAGCTTTGAGCGGGAGAG GGAAGGCCTTCAGAGTAGCGCCTGGACAGAAGAGAAGGTGAGAGGCTTG ACTCAGGAACTAGAGCAGTTTCACCAGGAGCAGCTGACAAGCCTGGTGG AGAAACACACTCTTGAGAAAGAGGAGTTAAGAAAAGAGCTCTTGGAAAA GCACCAAAGGGAGCTTCAGGAGGGAAGATATGAATCTGAAAAGCTTCAA CAGGAAAATTCTATTTTGAGAAATGAATTACTACTTTAAATGAAGAAGA TAGCATTTCTAACCTGAAATTAGGGACATTAAATGGATCTCAGGAAGAAA TGTGGCAAAAAACGGAAACTGTAAAACAAGAAAATGCTGCAGTTCAGAA GATGGTTGAAAATTTAAAGAAACAGATTTCAGAATTAAAAATCAAAAAC CAACAATTGGATTTGGAAAATACAGAACTTAGCCAAAAGAACTCTCAAA ACCAGGAAAAACTGCAAGAACTTAATCAACGTCTAACAGAAATGCTATG CCAGAAGGAAAAAGAGCCAGGAAACAGTGCATTGGAGGAACGGGAACA AGAGAAGTTTAATCTGAAAGAAGAACTGGAACGTTGTAAAGTGCAGTCC TCCACTTTAGTGTCTTCTCTGGAGGCGGAGCTCTCTGAAGTTAAAATACA GACCCATATTGTGCAACAGGAAACCACCTTCTCAAAGATGAACTGGAG AAAATGAAACAGCTGCACAGATGTCCCGATCTCTCTGACTTCCAGCAAAA AATCTCTAGTGTTCTAAGCTACAACGAAAAACTGCTGAAAGAAAAGGAA GCTCTGAGTGAGGAATTAAATAGCTGTGTCGATAAGTTGGCAAAATCAAG TCTTTTAGAGCATAGAATTGCGACGATGAAGCAGGAACAGAAATCCTGG GAACATCAGAGTGCGAGCTTAAAGTCACAGCTGGTGGCTTCTCAGGAAA AGGTTCAGAATTTAGAAGACACCGTGCAGAATGTAAACCTGCAAATGTCC CGGATGAAATCTGACCTACGAGTGACTCAGCAGGAAAAGGAGGCTTTAA AACAAGAAGTGATGTCTTTACATAAGCAACTTCAGAATGCTGGTGGCAAG AGCTGGGCCCCAGAGATAGCTACTCATCCATCAGGGCTCCATAACCAGCA GAAAAGGCTGTCCTGGGACAAGTTGGATCATCTGATGAATGAGGAACAG CAGCTGCTTTGGCAAGAGAATGAGAGGCTCCAGACCATGGTACAGAACA CCAAAGCCGAACTCACGCACTCCCGGGAGAAGGTCCGTCAGTTGGAATC | SEQ ID NO: 47 |

TABLE B-continued

| Gene Fusion | Chimera Sequence | SEQ ID NO. |
|---|---|---|
| | CAATCTTCTTCCCAAGCACCAAAAACATCTAAACCCATCAGGTACCATGA<br>ATCCCACAGAGCAAGAAAAATTGAGCTTAAAGAGAGAGTGTGATCAGTT<br>TCAGAAAGAACAATCTCCTGCTAACAGGAAGGTCAGTCAGATGAATTCCC<br>TTGAACAAGAATTAGAAACAATTCATTTGGAAAATGAAGGCCTGAAAAA<br>GAAACAAGTAAAACTGGATGAGCAGCTCATGGAGATGCAGCACCTGAGG<br>TCCACTGCGACGCCTAGCCCGTCCCCTCATGCTTGGGATTTGCAGCTGCTC<br>CAGCAGCAAGCCTGTCCGATGGTGCCCAGGGAGCAGTTTCTGCAGCTTCA<br>ACGCCAGCTGCTGCAGGCAGAAAGGATAAACCAGCACCTGCAGGAGGAA<br>CTTGAAAACAGGACCTCCGAAACCAACACACCACAGGGAAACCAGGAAC<br>AACTGGTAACTGTCATGGAGGAACGAATGATAGAAGTTGAACAGAAACT<br>GAAACTAGTGAAAAGGCTTCTTCAAGAGAAAGTGAATCAGCTCAAAGAA<br>CAAGTGAGCCTACCCGGTCATCTCTGTTCACCCACCTCACATTCCAGCTTT<br>AACTCCAGTTTTACATCCCTTTATTGCCATTAA | |
| RERG-><br>GZMM | ATGGCTAAAAGTGCGGAGGTCAAACTGGCAATATTTGGGAGAGCAGGCG<br>TGGGCAAGTCAGGCAGCTCCTTTGGGACCCAGATCATCGGGGGCCGGGA<br>GGTGATCCCCCACTCGCGCCCGTACATGGCCTCACTGCAGAGAAATGGCT<br>CCCACCTGTGCGGGGGTGTCCTGGTGCACCCAAAGTGGGTGCTGACGGCT<br>GCCCACTGCCTGGCCCAGCGATGGCCCAGCTGAGGCTGGTGCTGGGGCT<br>CCACACCCTGGACAGCCCCGGTCTCACCTTCCACATCAAGGCAGCCATCC<br>AGCACCCTCGCTACAAGCCCGTCCCTGCCCTGGAGAACGACCTCGCGCTG<br>CTTCAGCTGGACGGGAAAGTGAAGCCCAGCCGGACCATCCGGCCGTTGG<br>CCCTGCCCAGTAAGCGCCAGGTGGTGGCAGCAGGGACTCGGTGCAGCAT<br>GGCCGGCTGGGGGCTGACCCACCAGGGCGGGCGCCTGTCCCGGGTGCTG<br>CGGGAGCTGGACCTCCAAGTGCTGGACACCCGCATGTGTAACAACAGCC<br>GCTTCTGGAACGCAGCCTCTCCCCCAGCATGGTCTGCCTGGCGGCCGAC<br>TCCAAGGACCAGGCTCCCTGCAAGGGTGACTCGGGCGGGCCCCTGGTGTG<br>TGGCAAAGGCCGGGTGTTGGCCAGAGTCCTGTCCTTCAGCTCCAGGGTCT<br>GCACTGACATCTTCAAGCCTCCCGTGGCCACCGCTGTGGCGCCTTACGTG<br>TCCTGGATCAGGAAGGTCACCGGCCGATCGGCCTGA | SEQ ID NO: 48 |
| DMKN-><br>LGI4 | ATGAAGTTCCAGGGGCCCCTGGCCTGCCTCCTGCTGGCCCTCTGCCTGGG<br>CAGTGGGGAGGCTGGCCCCCTGCAGAGCGGAGAGGAAAGCACTGGGACA<br>AATATTGGGGAGGCCCTTGGACATGGCCTGGGAGACGCCCTGAGCGAAG<br>GGGTGGGAAAGGCCATTGGCAAAGAGGCCGGAGGGGCAGCTGGCTCTAA<br>AGTCAGTGAGGCCCTTGGCCAAGGGACCAGAGAAGCAGTTGGCACTGGA<br>GTCAGGCAGGTTCCAGGCTTTGGCGTAGCAGATGCTTTGGGCAACAGGGT<br>CGGGGAAGCAGCCCATGCTCTGGGAAACACTGGGCACGAGATTGGCAGA<br>CAGGCAGAAGATGTCATTCGACACGGAGCAGATGCTGTCCGGGCTCCTG<br>GCAGGGGGTGCCTGGCCACAATGGTGCTTGGGAAACTTCTGGAGGCCAT<br>GGCATCTTTGGCTCTCAAGGTGGCCTTGGAGGCCAGGGCCAGGGCAATCC<br>TGGAGGTCTGGGGACTCCGTGGGTCCACGGATACCCCGGAAACTCAGCA<br>GGCAGCTTTGGAATGAATCCTCAGGGAGCTCCCTGGGGTCAAGGAGGCA<br>ATGGAGGGCCACCAAACTTTGGGACCAACACTCAGGGAGCTGTGGCCCA<br>GCCTGGCTATGGTTCAGTGAGAGCCAGCAACCAGAATGAAGGGTGCACG<br>AATCCCCCACCATCTGGCTCAGGTGGAGGCTCCAGCAACTCTGGGGGAGG<br>CAGCGGCTCACAGTGGGCAGCAGTGGCAGTGGCAGCAATGGTGACAAC<br>AACAATGGCAGCAGCAGTGGTGGCAGCAGCAGTGGCAGCAGCAGTGGCG<br>GCAGCAGTGGCGGCAGCAGTGGTGGCAGCAGTGGCAACAGTGGTGGCAG<br>CAGAGGTGACAGCGGCAGTGAGTCCTCCTGGGGATCCAGCACCGGCTCCT<br>CCTCCGGCAACCACGGTGGGAGCGGCGGAGGAAATGGACATAAACCCGG<br>GTGTGAAAAGCCAGGGAATGAAGCCCGCGGGAGCGGGGAATCTGGGATT<br>CAGAACTCTGAGACGTCTCCTGGGATGTTTAACTTTGACACTTTCTGGAA<br>GAATTTTAAATCCAAGCTGGGTTTCATCAACTGGGATGCCATAAACAAGA<br>ACCAGGTCCCGCCCCCCAGCACCCGAGCCCTCCTCTACTTCAGCGACTC<br>TGGGAGGATTTCAAACAGAACACTCCTTTCCTCAACTGGAAAGCAATTAT<br>TGAGGGTGCGGACGCGTCATCACTGCAGAAACGTGCAGGCAGAGACGAT<br>CAGAACTACAATTACAACCAGCATGCGTATCCCACTGCCTATGGTGGGAA<br>GTACTCAGTCAAGACCCCTGCAAAGGGGGGAGTCTCACCTTCTTCCTCGG<br>CTTCCCGGGTGCAACCTGGCCTGCTGCAGTGGGTGAAGTTTTGGTAGAGC<br>TGTCCTGGTTCCAGACGGTGGGGGAGTCGGCACTGAGCGTAGAGCCCTTC<br>TCCTACCAAGGGGAGCCTCACATTGTGCTGGCACAGCCCTTCGCCGGCCG<br>CTGCCTGATTCTCCTGGGACTACAGCCTGCAGCGCTTCCGGCCCGAGG<br>AAGAGCTGCCCGCGGCCTCCGTGGTGTCCTGCAAGCCACTGGTGCTGGGC<br>CCGAGCCTCTTCGTGCTGGCTGCCCGCCTGTGGGGGGGCTCACAGCTGTG<br>GGCCCGGCCCAGTCCCGGCCTGCGCCTGGCCCCAACGCAGACCCTGGCCC<br>CGCGGCGGCTGCTGCGGCCCAATGACGCCGAGCTCCTGTGGCTGGAAGG<br>GCAACCCTGCTTCGTGGTGGCCGATGCCTCCAAGGCGGGCAGCACCACGC<br>TGCTGTGCCGCGACGGGCCCGGCTTTTACCGCACCAGAGCCTGCACGCC<br>TGGCACCGGGACACGGACGCTGAGGCCCTGGAGCTGGACGGCCGGCCCC<br>ACCTGCTGCTGGCCTCGGCTTCCCAGCGGCCCGTGCTCTTCCACTGGACC<br>GGTGGCCGCTTCGAGAGACGCACAGACATCCCCGAGGCCGAGGATGTCT<br>ATGCCACACGCCACTTCCAGGCTGGTGGGGACGTGTTCCTGTGCCTCACA<br>CGCTACATTGGGGACTCCATGGTCATGCGCTGGGACGGCTCCATGTTTCG<br>TCTGCTGCAGCAACTTCCCTCGCGCGGTGCCCACGTCTTCCAGCCACTGCT<br>CATCGCCAGGGACCAGCTGGCCATCCTAGGCAGCGACTTCGCCTTCAGCC<br>AGGTCCTCCGCCTTGAGCCTGACAAGGGGCTCCTGGAGCCACTGCAGGAG | SEQ ID NO: 49 |

TABLE B-continued

| Gene Fusion | Chimera Sequence | SEQ ID NO. |
|---|---|---|
| | CTGGGGCCTCCGGCCCTGGTGGCCCCCCGTGCCTTTGCCCACATCACTAT GGCCGGCAGACGCTTCCTCTTTGCTGCTTGCTTTAAGGGCCCCACACAGA TCTACCAGCATCACGAGATCGACCTCAGTGCCTGA | |
| UTP18-> ACACA | ATGCCGCCGGAGCGGAGGAGACGAATGAAACTGGACCGGAGAACCGGA GCGAAGCCGAAGCGGAAGCCCGGAATGAGGCCGGACTGGAAAGCCGGA GCGGGGCCAGGCGGGCCTCCCCAAAAGCCTGCCCCTTCATCCCAGCGGA AACCGCCGGCCCGGCCGAGCGCGGCGGCCGCTGCGATTGCAGTCGCGGC GGCGGAGGAAGAGAGACGGCTCCGGCAGCGGAACCGCCTGAGGCTGGA GGAGGACAAACCGGCCGTGGAGCGGTGCTTGGAGGAGCTGGTCTTCGGC GACGTCGAGAACGACGAGGACGCGTTGCTGCGGCGTCTGCGAGGCCCGA GGGTTCAAGAACATGAAGACTCGGGTGACTCAGAAGTGGAGAATGAAGC AAAAGGTAATTTTCCACCTCAAAAGAAGCCAGTTTGGGTGGATGAAGAA GATGAAGATGAGGAAATGGTTGACATGATGAACAATCGGTTTCGGAAGG ATATGATGAAAAATGCTAGTGAAAGTAAACTTTCGAAAGACAACCTTAA AAAGAGACTTAAAGAAGAATTCCAACATGCCATGGGAGGAGTACCTGCC TGGGCAGAGACTACTAAGCGGAAAACATCTTCAGATGATGAAAGTGAAG AGGATGAAGATGATTTGTTGCAAAGGACTGGGAATTTCATATCCACATCA ACTTCTCTTCCAAGAGGAATCTTGAAGATGAAGAACTGCCAGCATGCGAA TGCTGAACGTCCTACTGTTGCTCGGATCTCATCTGTGCAGTTCCATCCCGG TGCACAGATTGTGATGGTTGCTGGATTAGATAATGCTGTATCACTATTTCA GGTTGATGGGAAAACAAATCCTAAAATTCAGAGCATCTATTTGGAAAGGT TTCCAATCTTTAAGGCTTGTTTTAGTGCTAATGGGGAAGAAGTTTTAGCCA CGAGTACCCACAGCAAGGTTCTTTATGTCTATGACATGCTGGCTGGAAAG TTAATTCCTGTGCATCAAGTGAGAGGTCCTCGGGCGGGAAGTGTACACCT CCAATAACCAGCTGGGGGCATCCAGATTATGCACAACAATGGGGTGAC CCACTGCACTGTGTGTGATGACTTTGAAGGGGTTTTCACTGTCCTGCACTG GCTGTCTTACATGCCCAAGAGCGTGCACAGTTCAGTTCCTCTTCTGAACTC AAAGGATCCTATAGACAGAATCATCGAGTTTGTTCCCACAAAGACCCCAT ACGATCCTCGATGGATGCTAGCAGGCCGTCCTCACCCAACCCAAAAAGGT CAGTGGTTGAGTGGCTTTTTTGACTATGGATCTTTCTCAGAGATTATGCAG CCCTGGGCACAGACTGTGGTGGTTGGTAGAGCCAGGCTAGGAGGAATAC CTGTGGGAGTTGTTGCTGTAGAAACCCGAACAGTAGAACTAAGTATCCCA GCTGATCCAGCAAACCTGGATTCTGAAGCCAAGATAATCCAGCAGGCTG GCCAGGTTTGGTTCCCAGATTCTGCGTTTAAGCATATCAGGCCGCATCAAG GACTTCAACCGGGAAGGGCTGCCTCTGATGGTCTTTGCCAACTGGAGAGG CTTCTCTGGTGGAATGAAAGATATGTACGACCAAGTGCTGAAGTTTGGTG CTTACATTGTGGATGGCTTGAGGGAGTGCTGCCAGCCTGTGCTGGTTTAC ATTCCTCCCCAGGCTGAGCTGCGGGGTGGCTCCTGGGTGGTGATTGACTC CTCCATCAACCCCGGCACATGGAGATGTATGTGACCGAGAAAGCAGG GGATCTGTTCTGGAGCCAGAAGGGACAGTAGAAATCAAATTCCGCAGAA AGGATCTGGTGAAAACCATGCGTCGGGTGGACCCAGTCTACATCCACTTG GCTGAGCGATTGGGGACCCCAGAGCTAAGCACAGCTGAGCGGAAGGAGT TGGAGAACAAGTTGAAGGAGCGGGAGGAATTCCTAATTCCCATTTACCAT CAGGTAGCCGTGCAGTTTGCTGACTTGCACGACACACCAGGCCGGATGCA GGAGAAGGGTGTTATTAGCGATATCCTGGATTGGAAAACATCCCGTACCT TCTTCTACTGGCGGCTGAGGCGTCTTCTGCTGGAGGACCTGGTCAAGAAG AAAATCCACAATGCCAACCCTGAGCTGACTGATGGCCAGATTCAAGCCAT GTTAAGGCGCTGGTTTGTGGAAGTGGAAGGAACAGTGAAGGCTTATGTTT GGGACAATAATAAGGATCTGGCGGAGTGGCTAGAGAAACAGCTGACAGA GGAGGATGGTGTTCACTCGGTAATAGAGGAAAACATCAAATGCATCAGC AGAGACTACGTCCTCAAGCAAATCCGCAGCTTGGTCCAGGCCAATCCAGA GGTTGCCATGGATTCCATCATCCATATGACGCAGCACATATCACCCACTC AGCGAGCAGAAGTCATACGGATCCTCTCCACAATGGATTCCCCTTCCACG TAG | SEQ ID NO: 50 |
| APP-> C21orf7 | ATGCTGCCCGGTTTGGCACTGCTCCTGCTGGCCGCCTGGACGGCTCGGGC GCTGGAGGTACCCACTGATGGTAATGCTGGCCTGCTGGCTGAACCCCAGA TTGCCATGTTCTGTGGCAGACTGAACATGCACATGAATGTCCAGAATGGG AAGTGGGATTCAGATCCATCAGGGACCAAAACCTGCATTGATACAAGG AAGGCATCCTGCAGTATTGCCAAGAAGTCTACCCTGAACTGCAGATCACC AATGTGGTAGAAGCCAACCAACCAGTGACCATCCAGAACTGGTGCAAGC GGGGCCGCAAGCAGTGCAAGACCCATCCCCACTTTGTGATTCCCTACCGC TGCTTAGTTGGTGAGTTTGTAAGTGATGCCCTTCTCGTTCCTGACAAGTGC AAATTCTTACACCAGGAGAGGATGGATGTTGCGAAACTCATCTTCACTG GCACACCGTCGCCAAAGAGACATGCAGTGAGAAGAGTACCAACTTGCAT GACTACGGCATGTTGCTGCCCTGCGGAATTGACAAGTTCCGAGGGGTAGA GTTTGTGTGTTGCCCACTGGCTGAAGAAAGTGACAATGTGGATTCTGCTG ATGCGGAGGAGGATGACTCGGATGTCTGGTGGGGCGGAGCAGACACAGA CTATGCAGATGGGAGTGAAGACAAAGTAGTAGAAGTAGCAGAGGAGGA AGAAGTGGCTGAGGTGGAAGAAGAAGAAGCCGATGATGACGAGGACGA TGAGGATGGTGATGAGGTAGAGGAAGAGGCTGAGGAACCCTACGAAGAA GCCACAGAGAGAACCACCAGCATTGCCACCACCACCACCACCACCACAG AGTCTGTGGAAGAGGTGGTTCGAGAGGTGTGCTCTGAACAAGCCGAGAC GGGGCCGTGCCGAGCAATGATCTCCCGCTGGTACTTTGATGTGACTGAAG GGAAGTGTGCCCCATTCTTTTACGGCGGATGTGGCGGCAACCGGAACAAC TTTGACACAGAAGAGTACTGCATGGCCGTGTGTGGCAGCGCCATGTCCCA | SEQ ID NO: 51 |

TABLE B-continued

| Gene Fusion | Chimera Sequence | SEQ ID NO. |
|---|---|---|
| | AAGTTTACTCAAGACTACCCAGGAACCTCTTGCCCGAGATCCTGTTAAAC TTCCTACAACAGCAGCCAGTACCCCTGATGCCGTTGACAAGTATCTCGAG ACACCTGGGGATGAGAATGAACATGCCCATTTCCAGAAAGCCAAAGAGA GGCTTGAGGCCAAGCACCGAGAGAGAATGTCCCAGGTCATGAGAGAATG GGAAGAGGCAGAACGTCAAGCAAAGAACTTGCCTAAAGCTGATAAGAAG GCAGTTATCCAGCATTTCCAGGAGAAAGTGGAATCTTTGGAACAGGAAG CAGCCAACGAGAGACAGCAGCTGGTGGAGACACACATGGCCAGAGTGGA AGCCATGCTCAATGACCGCCGCCGCCTGGCCCTGGAGAACTACATCACCG CTCTGCAGGCTGTTCCTCCTCGGCCTCGTCACGTGTTCAATATGCTAAAGA AGTATGTCCGCGCAGAACAGAAGGACAGACAGCACACCCTAAAGCATTT CGAGCATGTGCGCATGGTGGATCCCAAGAAAGCCGCTCAGATCCGGTCCC AGGTTATGACACACCTCCGTGTGATTTATGAGCGCATGAATCAGTCTCTC TCCCTGCTCTACAACGTGCCTGCAGTGGCCGAGGAGATTCAGGATGAAGT TGGAAGGAGCTCATTGCCAAGTTAGATCAGGCAGAAAAGGAGAAGGTGG ATGCTGCTGAGCTGGTTCGGGAATTCGAGGCTCTGACGGAGGAGAATCG GACGTTGAGGTTGGCCCAGTCTCAATGTGTGGAACAACTGGAGAAACTTC GAATACAGTATCAGAAGAGGCAGGGCTCGTCCTAA | |
| GREB1-> MBOAT2 | GCATTACGCGCCCCACGCATCCTCTTCCATCCCCAGGCACAGATCAAAGG CGCAGCCCAGGAGGCGGGAGCCCTGCACACTTTCCACCTCTGCTGGGCT TAGCCTCTTGGCTGGTTGGTCTGTGGAGTGCCTGAAGTGACCAGCTTTTTG TAAGGTCAACTTTGTAGTGTGCCAACTCTTTGCCTTGCTAGCAGCCATTTG GTTTCGAACTTATCTACATTCAAGCAAAACTAGCTCTTTTATAAGACATGT AGTTGCTACCCTTTTGGGCCTTTATCTTGCACTTTTTTGCTTTGGATGGTAT GCCTTACACTTCTTGTACAAAGTGGAATTTCCTACTGTATCATGATCATC ATAGGAGTGGAGAACATGCACAATTACTGCTTTGTGTTTGCTCTGGGATA CCTCACAGTGTGCCAAGTTACTCGAGTCTATATCTTTGACTATGGACAAT ATTCTGCTGATTTTTCAGGCCCAATGATGATCATTACTCAGAAGATCACTA GTTTGGCTTGCGAAATTCATGATGGGATGTTCGGAAGGATGAAGAACTG ACTTCCTCACAGAGGGATTTAGCTGTAAGGCGCATGCCAAGCTTACTGGA GTATTTGAGTTACAACTGTAACTTCATGGGGATCCTGGCAGGCCCACTTT GCTCTTACAAAGACTACATTACTTTCATTGAAGGCAGATCATACCATATC ACACAATCTGGTGAAAATGGAAAAGAAGAGACACAGTATGAAAGAACA GAGCCATCTCCAAATACTGCGGTTGTTCAGAAGCTCTTAGTTTGTGGGCT GTCCTTGTTATTTCACTTGACCATCTGTACAACATTACCTGTGGAGTACAA CATTGATGAGCATTTTCAAGCTACACGTTCGTGGCCAACAAAGATTATCT ATCTGTATATCTCTCTTTTGGCTGCCAGACCCAAATACTATTTTGCATGGA CGCTAGCTGATGCCATTAATAATGCTGCAGGCTTTGGTTTCAGAGGGTAT GACGAAAATGGAGCAGCTCGCTGGGACTTAATTTCCAATTTGAGAATTCA ACAAATAGAGATGTCAACAAGTTTCAAGATGTTTCTTGATAATTGGAATA TTCAGACAGCTCTTTGGCTCAAAAGGGTGTGTTATGAACGAACCTCCTTC AGTCCAACTATCCAGACGTTCATTCTCTCTGCCATTTGGCACGGGGTATAC CCAGGATATTATCTAACGTTTCTAACAGGGGTGTTAATGACATTAGCAGC AAGAGCTATGAGAAATAACTTTAGACATTATTTCATTGAACCTTCCCAAC TGAAATTATTTTATGATGTTATAACATGGATAGTAACTCAAGTAGCAATA AGTTACACAGTTGTGCCATTTGTGCTTCTTTCTATAAAACCATCACTCACG TTTTACAGCTCCTGGTATTATTGCCTGCACATTCTTGGTATCTTAGTATTAT TGTTGTTGCCAGTGAAAAAAACTCAAAGAAGAAAGAATACACATGAAAA CATTCAGCTCTCACAATCCAAAAAGTTTGATGAAGGAGAAAATTCTTTGG GACAGAACAGTTTTTCTACAACAAACAATGTTTGCAATCAGAATCAAGAA ATAGCCTCGAGACATTCATCACTAAAGCAGTGATCGGGAAGGCTCTGAG GGCTGTTTTTTTTTTTGATGTTAACAGAAACCAATCTTAGCACCTTTTCA AGGGGTTTGAGTTGTTGGAAAAGCAGTTAACTGGGGGGAAATGGACAG TTATAGATAAGGAATTTCCTGTACACCAGATTGGAAATGGAGTGAAACAA GCCCTCCCATGCCATGTCTCCGTGGGCCACGCCTTATGTAAGAATATTTCC ATATTTCAGTGGGCACTCCCAACCTCAGCACTTGTCCGTAGGGTCACACG CGTGCCCTGTTGCTGAATGTATGTTGCGTATCCAAGGCACTGAAGAGGT GGAAAAATAATCGTGTCAATCTGGATGATAGAGAGAAATTAACTTTTCCA AATGAATGTCTTGCCTTAAACCCTCTATTTCCTAAAATATTGTTCCTAAAT GGTATTTTCAAGTGTAATATTGTGAGAACGCTACTGCAGTAGTTGATGTT GTGTGCTGTAAAGGATTTTAGGAGGAATTTGAAACAGGATATTTAAGAGT GTGGATATTTTAAAATGCAATAAACATCTCAGTATTTGAAGGGTTTTCTT AAAGTATGTCAAATGACTACAATCCATAGTGAAACTGTAAACAGTAATG GACGCCAAATTATAGGTAGCTGATTTTGCTGGAGTTTAATTACCTTGT GCAGTCAAAGAGCGCTTCAGAAGGAATCTCTTAAAACATAATGAGAGG TTTGGTAATGTGATATTTAAGCTTATTCTTTTTCTTAAAAGAGAGAGGTG ACGAAGGAAGGCAGGAATGAAGAAGCACTGCGTGGCCTCCGGTGGAATG CACGGGGCACAGCCGCGACTCTGCAGGCAGCTTCCCCCCCATGCCAGGGC TCTGCGCCGTCATGTGAGACTTAAAAAAAAAGTTGAATGACTTCGTGATA CTTTGGACTTCTAAATTAAATTTATCAGGCATAAATTATGTAGAATTAGA GGCTTTGAAAATAATACTGGTAGGTTGCTCAAAGGTTTTGAAAGAGAAAT CGCTAGGTAGGTTACTATCTGGCTAATCCATTTCTTATCCTTGACAATTTA ATTCATATTTGGGAAACTTTTAGGGAAATGAAAAATAAAAGTCACTGAGT CTGGGTGACATTTTTTAAGAATAATATAAATTCAGTTTCAAACTCTTCTCA CATTAAAATTTTGCTGTGAACTCTTACTAAAATGAGTTTTAGGTTCTGTAA GTGGAAAAATGTGCTTTTATTTTATGGGCCATTTTTACCACAACTAATCTT GCCTTGGATTACTAAGCATCTCCTGCGATCCCACAGAGGACTGTGGTGGC | SEQ ID NO: 52 |

TABLE B-continued

| Gene Fusion | Chimera Sequence | SEQ ID NO. |
|---|---|---|
| | CACAGGAGCTGAAAGCAGAAGAGTGGGATTTGATGCCAGGCAGTGGAGT GGCCTCAGCCCCAGATTGTACCTCCTGCCCTGTAGGAGGGGAGGGGCA AAGCCTTCTGACTTCACCTTTGTTTGACCTATGTATGGAACTTACTTTTAC TTTTTGCCTTAAATTTTTAATGAAATGCAAATTTTCTGTGATGGGGTTCTC TCTCTCTTTTTTTCGGGGGGTGGAGTCACTAATAAATTTGCAAATGAAGTT AAAGACAAGGCAACCATCTGGCTTATGCTATATAATACTTCATTTAAAGA AGAAAGGAAAAGCAAATGCACTTGCAGCTTTTGAGGTCTCAGCAAAAAT GGGCATGTGTCTTTTTTGAAGTTTAGAAATATCCTAATCTATTTTTATTTA TCTAAAAGTAAGTGTTTTCCGGCTGATAAGGCTAACCCTACCCAGGAAAG GATTGATAACTAAATAAATTTCCTCTGTTTTCCCATGCATTGAAATTATGT TGGCTGAGCATGGTGGCTCACACCTGTAATCCTAGCACTTTGGGAGGCCG AGGTGGGCGGATCACTTGAGGTCAGGAGTTGGAGACCAGCCTGGCCAAC GTGGTGAATCCCCGTCTCTACTGAAAACACAAAAATTAGACGGGCATGGT GGCGCACACCTGTAATCCCAGCTACTTGGGAGGCTGAGGCAGGAGAATT GCTTGAACCTGGGAGGTGGAGGTTGCAGTGAGCTAAAATTGTGCCACTGC ACTCCAGCCTGGGTGACAGAGGAAGACTCCGTCTCAC | |
| MED13L-> KIF21A | ATGACTGCGGCAGCGAACTGGGTGGCGAACGGGGCGAGCCTGGAGGATT GTCACTCCAACCTCTTTTCGCTGGCTGAACTCACGGGAATCAAATGGCGT AGGTACAATTTTGGAGGGCATGGGGACTGTGGACCCATAATTTCAGCCCC AGCCCAAGATGATCCAATTCTGTTAAGTTTCATCCGCTGTCTGCAAGCTA ACCTGCTTTGTGTATGGCGTCGTGATGTCAAACCAGATTGCAAAGAGTTA TGGATATTCTGGTGGGGAGATGAACCCAACCTAGTGGGTGTAATACATCA TGAACTGCAGGTTGTGGAAGAAGGACTCTGGGAAATGGCCTTTCCTATG AATGTAGGACGCTGCTCTTCAAAGCGATCCACAATCTGTTAGAAAGGTGC CTAATGGATAAGAACTTCGTTAGGATTGGGAAATGGTTTGTCCGACCCTA CGAAAAGGATGAAAAGCCAGTCAACAAAAGTGAGCATTTGTCCTGTGCT TTCACATTCTTTCTGCATGGAGAAAGTAATGTATGCACAAGTGTGGAGAT TGCCCAGCACCAGCCAATTTATTTGATCAATGAGGAGCATATACACATGG CTCAGTCTTCACCTGCACCATTTCAAGTACTGGTAAGTCCTTATGGCTTAA ATGGGACGCTAACAGGCCAAGCATACAAGATGTCAGACCCAGCCACTCG TAAGTTGATTGAGGAATGGCAGTATTTCTACCCGATGGTGCTAAAAAAGA AAGAAGAATCGAAAGAGGAAGACGAGTTGGGATATGATGATGATTTCCC TGTGGCAGTTGAAGTAATTGTTGGTGGTGTTCGGATGGTTTACCCTTCAGC ATTTGTTTTGATCTCTCAGAATGACATCCCGGTTCCTCAGAGTGTTGCCAG TGCTGGAGGCCACATTGCAGTTGGGCAGCAAGGGCTTGGTAGTGTGAAG GACCCAAGTAACTGTGGGATGCCTCTGACCCCTCCCACCTCTCAGAACA GGCTATCCTAGGTGAGAGTGGAGGTATGCAGAGTGCTGCCAGTCACCTGG TTTCCCAAGATGGAGGGATGATAACGATGCACAGTCCAAAGAGATCGGG GAAGATTCCTCCAAAACTCCACAATCATATGGTCCATCGAGTCTGGAAGG AATGCATCCTCAACAGAACCCAGTCCAAGAGGAGCCAAATGTCAACTCC AACTCTTGAAGAAGAGCCTGCTAGCAATCCTGCTACTTGGGATTTTGTGG ATCCAACCCAAAGAGTCAGCTGTTCTTGTTCCAGAATAAGACCACAGCTT GCCAAAGAGAAGATTGAAGGATGCCATATTTGTACATCTGTCACACCAGG AGAGCCTCAGGTCTTCCTAGGGAAAGATAAGGCTTTTACTTTTTGACTATG TATTTGACATTGACTCCCAGCAAGAGCAGATCTACATTCAATGTATAGAA AAACTAATTGAAGGTTGCTTTGAAGGATACAATGCTACAGTTTTTGCTTA TGGACAAACTGGAGCTGGTAAAACATACACAATGGGAACAGGATTTGAT GTTAACATTGTTGAGGAAGAACTGGGTATTATTTCTCGAGCTGTTAAACA CCTTTTTAAGAGTATTGAAGAAAAAAACACATAGCAATTAAAAATGGG CTTCCTGCTCCAGATTTTAAAGTGAATGCCCAATTCTTAGAGCTCTATAAT GAAGAGGTCCTTGACTTATTTGATACCACTCGTGATATTGATGCAAAAAG TAAAAAATCAAATATAAGAATTCATGAAGATTCAACTGGAGGAATTTATA CTGTGGGCGTTACAACACGTACTGTGAATACAGAATCAGAGATGATGCA GTGTTTGAAGTTGGGTGCTTTATCCCGGACAACTGCCAGTACCCAGATGA ATGTTCAGAGCTCTCGTTCACATGCCATTTTTACCATTCATGTGTGTCAAA CCAGAGTGTGTCCCCAAATAGATGCTGACAATGCAACTGATAATAAAATT ATTTCTGAATCAGCACAGATGAATGAATTTGAAACCCTGACTGCAAAGTT CCATTTTGTTGATCTCGCAGGATCTGAAAGACTGAAGCGTACTGGAGCTA CAGGCGAGAGGGCAAAAGAAGGCATTTCTATCAACTGTGGACTTTTGGC ACTTGGCAATGTAATAAGTGCCTTGGGAGACAAGAGCAAGAGGGCCACA CATGTCCCCTATAGAGATTCCAAGCTAACAAGACTACTACAGGATTCCCT CGGGGGTAATAGCCAAACAATCATGATAGCATGTGTCAGCCCTTCAGACA GAGACTTTATGGAAACGTTAAACACCCTGAAATACGCCAATCGAGCTAG AAATATCAAGAATAAGGTGATGGTCAATCAGGACAGAGCTAGTCAGCAA ATCAATGCACTTCGTAGTGAAATCACACGACTTCAGATGGAGCTCATGGA GTACAAAACAGGTAAAAGAATAATTGACGAAGAGGGTGTGGAAAGCATC AATGACATGTTTCATGAGAATGCTATGCTACAGACTGAAAATAATAACCT GCGTGTAAGAATTAAAGCCATGCAAGAGACGGTTGATGCATTGAGGTCC AGAATTACACAGCTTGTTAGTGATCAGGCCAACCATGTTCTTGCCAGAGC AGGTGAAGGAAATGAGGAGATTAGTAATATGATTCATAGTTATATAAAA GAAATCGAAGATCTCAGGGCAAAATTATTAGAAAGTGAAGCAGTGAATG AGAACCTTCGAAAAAACTTGACAAGAGCCACAGCAAGAGCGCCATATTT CAGCGGATCATCAACTTTTTCTCCTACCATACTATCCTCAGACAAAGAAA CCATTGAAATTATAGACCTAGCAAAAAAAGATTTAGAGAAGTTGAAAAG AAAAGAAAGAGGAAGAAAAAAAGTGTGGCTGGTAAAGAGGATAATAC AGACACTGACCAAGAGAAGAAAGAAGAAAAGGGTGTTTCGGAAAGAGA | SEQ ID NO: 53 |

TABLE B-continued

| Gene Fusion | Chimera Sequence | SEQ ID NO. |
|---|---|---|
| | AAACAATGAATTAGAAGTGGAAGAAAGTCAAGAAGTGAGTGATCATGAG GATGAAGAAGAGGAGGAGGAGGAGGAAGATGACATTGATGGGGGT GAAAGTTCTGATGAATCAGATTCTGAATCAGATGAAAAAGCCAATTATCA AGCAGACTTGGCAAACATTACTTGTGAAATTGCAATTAAGCAAAAGCTGA TTGATGAACTAGAAAACAGCCAGAAAAGACTGCAGACTCTGAAAAAGCA GTATGAAGAGAAGCTAATGATGCTGCAACATAAAATTCGGGATACTCAG CTTGAAAGAGACCAGGTGCTTCAAAACTTAGGCTCGGTAGAATCTTACTC AGAAGAAAAAGCAAAAAAAGTTAGGTCTGAATATGAAAAGAAACTCCAA GCCATGAACAAAGAACTGCAGAGACTTCAAGCAGCTCAAAAAGAACATG CAAGGTTGCTTAAAAATCAGTCTCAGTATGAAAAGCAATTGAAGAAATTG CAGCAGGATGTGATGGAAATGAAAAAAACAAAGGTTCGCCTAATGAAAC AAATGAAAGAAGAACAAGAGAAAGCCAGACTGACTGAGTCTAGAAGAA ACAGAGAGATTGCTCAGTTGAAAAAGGATCAACGTAAAAGAGATCATCA ACTTAGACTTCTGGAAGCCCAAAAAAGAAACCAAGAAGTGGTTCTACGT CGCAAAACTGAAGAGGTTACGGCTCTTCGTCGGCAAGTAAGACCCATGTC AGATAAAGTGGCTGGGAAAGTTACTCGGAAGCTGAGTTCATCTGATGCAC CTGCTCAGGACACAGGTTCCAGTGCAGCTGCTGTCGAAACAGATGCATCA AGGACAGGAGCCCAGCAGAAAATGAGAATTCCTGTGGCGAGAGTCCAGG CCTTACCAACGCCGGCAACAAATGGAAACAGGAAAAAATATCAGAGGAA AGGATTGACTGGCCGAGTGTTTATTTCCAAGACAGCTCGCATGAAGTGGC AGCTCCTTGAGCGCAGGGTCACAGACATCATCATGCAGAAGATGACCATT TCCAACATGGAGGCAGATATGAATAGACTCCTCAAGCAACGGGAGGAAC TCACAAAAAGACGAGAGAAACTTTCAAAAAGAAGGGAGAAGATAGTCA AGGAGAATGGAGAGGGAGATAAAAATGTGGCTAATATCAATGAAGAGAT GGAGTCACTGACTGCTAATATCGATTACATCAATGACAGTATTTCTGATT GTCAGGCCAACATAATGCAGATGGAAGAAGCAAAGGAAGAAGGTGAGA CATTGGATGTTACTGCAGTCATTAATGCCTGCACCCTTACAGAAGCCCGA TACCTGCTAGATCACTTCCTGTCAATGGGCATCAATAAGGGTCTTCAGGC TGCCCAGAAAGAGGCTCAAATTAAAGTACTGGAAGGTCGACTCAAACAA ACAGAAATAACCAGTGCTACCCAAAACCAGTCTCTTATTCCATATGTTGAA AGAGAAGGCAGAATTAAATCCTGAGCTAGATGCTTTACTAGGCCATGCTT TACAAGATCTAGATAGCGTACCATTAGAAAATGTAGAGGATAGTACTGAT GAGGATGCTCCTTTAAACAGCCCAGGATCAGAAGGAAGCACGCTGTCTTC AGATCTCATGAAGCTTTGTGGTGAAGTGAAACCTAAGAACAAGGCCCGA AGGAGAACCACCACTCAGATGGAATTGCTGTATGCAGATAGCAGTGAAC TAGCTTCAGACACTAGTACAGGAGATGCCTCCTTGCCTGGCCCTCTCACA CCTGTTGCAGAAGGGCAAGAGATTGGAATGAATACAGAGACAAGTGGTA CTTCTGCTAGGGAAAAAGAGCTCTCTCCCCCACCTGGCTTACCTTCTAAG ATAGGCAGCATTTCCAGGCAGTCATCTCTATCAGAAAAAAAAATTCCAGA GCCTTCTCCTGTAACAAGGAGAAAGGCATATGAGAAAGCAGAAAAATCA AAGGCCAAGGAACAAAAGCACTCAGATTCTGGAACTTCAGAGGCTAGTC TTTCACCTCCTTCTTCCCCACCAAGCCGGCCCCGTAATGAACTGAATGTTT TTAATCGTCTTACTGTTTCTCAGGGAAACACATCAGTTCAGCAGGATAAG TCTGATGAAAGTGACTCCTCTCTCTCGGAGGTACACAGATCCTCCAGAAG GGGCATAATCAACCCATTTCCTGCTTCAAAAGGAATCAGAGCTTTTCCAC TTCAGTGTATTCACATAGCTGAAGGGCATACAAAAGCTGTGCTCTGTGTG GATTCTACTGATGATCTCCTCTTCACTGGATCAAAAGATCGTACTTGTAAA GTATGGAATCTGGTGACTGGGCAGGAAATAATGTCACTGGGGGGTCATCC CAACAATGTCGTGTCTGTAAAATACTGTAATTATACCAGTTTGGTCTTCAC TGTATCAACATCTTATATTAAGGTGTGGGATATCAGAGATTCAGCAAAGT GCATTCGAACACTAACGTCTTCAGGTCAAGTTACTCTTGGAGATGCTTGTT CTGCAAGTACCAGTCGAACAGTAGCTATTCCTTCTGGAGAGAACCAGATC AATCAAATTGCCCTAAACCCAACTGGCACCTTCCTCTATGCTGCTTCTGGA AATGCTGTCAGGATGTGGGATCTTAAAAGGTTTCAGTCTACAGGAAAGTT AACAGGACACCTAGGCCCTGTTATGTGCCTTACTGTGGATCAGATTTCCA GTGGACAAGATCTAATCATCACTGGCTCCAAGGATCATTACATCAAAATG TTTGATGTTACAGAAGGAGCTCTTGGGACTGTGAGTCCCACCCACAATTT TGAACCCCCTCATTATGATGGCATAGAAGCACTAACCATTCAAGGGGATA ACCTATTTAGTGGGTCTAGAGATAATGGAATCAAGAAATGGGACTTAACT CAAAAAGACCTTCTTCAGCAAGTTCCAAATGCACATAAGGATTGGGTCTG TGCCCTGGGAGTGGTGCCAGACCACCCAGTTTTGCTCAGTGGCTGCAGAG GGGGCATTTTGAAAGTCTGGAACATGGATACTTTTATGCCAGTGGGAGAG ATGAAGGGTCATGATAGTCCTATCAATGCCATATGTGTTAATTCCACCCA CATTTTTACTGCAGCTGATGATCGAACTGTGAGAATTTGGAAGGCTCGCA ATTTGCAAGATGGTCAGATCTCTGACACAGGAGATCTGGGGGAAGATATT GCCAGTAATTAA | |
| ITGA11-> NARF | ATGGACCTGCCCAGGGGCCTGGTGGTGGCCTGGGCGCTCAGCCTGTGGCC AGGGTTCACGGACACCTTCAACATGGACACCAGGAAGCCCCGGGTCATC CCTGCTCCAGGACCGCCTTCTTTGGCTACACAGTGCAGCAGCACGACAT CAGTGGCAATAAGTGGAATGTAGTAAGAAAACAAAAACTGATGACCAAG AGAATGTGTCAGCCGATGCACCGAGTCCAGCCCAGGAAATGGAGAGAA GGGAGAATTCCACAAGTTGGCTGATGCCAAGATATTTTTGAGCGACTGCC TGGCATGTGACAGCTGTATGACTGCAGAGGAAGGAGTCCAACTTTCCCAG CAAAATGCCAAGGACTTCTTCCGCGTTCTGAACCTTAACAAGAAATGTGA TACCTCAAAGCACAAAGTGCTGGTAGTGTCTGTGTGTCCTCAATCTTTGCC TTATTTTGCTGCTAAATTCAACCTCAGTGTAACTGATGCATCCAGAAGACT | SEQ ID NO: 54 |

TABLE B-continued

| Gene Fusion | Chimera Sequence | SEQ ID NO. |
|---|---|---|
| | CTGTGGTTTCCTCAAAAGTCTTGGGGTGCACTATGTATTTGATACGACGAT<br>AGCTGCGGATTTTAGTATCCTGGAGAGTCAAAAAGAATTCGTGCGTCGCT<br>ATCGCCAGCACAGTGAGGAGGAACGCACCCTGCCCATGCTGACCTCTGCC<br>TGTCCTGGCTGGGTCCGATACGCCGAGCGGGTGCTGGGTCGCCCCATCAC<br>TGCCCACCTCTGCACCGCCAAGTCCCCCCAGCAGGTCATGGGCTCTTTGG<br>TGAAGGATTATTTCGCCAGACAGCAGAACCTGTCTCCAGAGAAGATTTTC<br>CACGTCATTGTGGCCCCTTGTTATGACAAGAAGCTGGAGGCTCTTCAGGA<br>AAGCCTTCCCCCTGCTTTGCATGGCTCCCGGGGCGCTGACTGCGTGTTAA<br>CATCAGGTGAAATTGCTCAAATAATGGAGCAAGGTGACCTCTCAGTGAG<br>AGATGCTGCCGTCGACACTCTGTTTGGAGACTTGAAGGAGGACAAAGTG<br>ACGCGTCATGATGGAGCCAGCTCAGACGGGCACCTGGCACACATCTTCAG<br>ACATGCGGCCAAGGAGCTGTTCAACGAGGATGTGGAGGAGGTCACTTAC<br>CGAGCCCTGAGAAACAAAGACTTCCAAGAGGTCACCCTTGAGAAGAACG<br>GAGAGGTGGTGTTACGCTTTGCTGCAGCCTATGGCTTTCGAAACATCCAG<br>AACATGATCCTGAAGCTTAAGAAGGGCAAGTTCCCATTCCACTTTGTGGA<br>GGTCCTCGCCTGTGCTGGAGGATGCTTAAATGGCAGAGGCCAAGCCCAG<br>ACTCCAGACGGACATGCGGATAAGGCCCTGCTGCGGCAGATGGAAGGCA<br>TTTACGCTGACATCCCTGTGCGGCGTCCGGAGTCCAGTGCACACGTGCAG<br>GAGCTGTACCAGGAGTGGCTGGAGGGGATCAACTCCCCCAAGGCCCGAG<br>AGGTGCTGCATACCACGTACCAGAGCCAGGAGCGTGGCACACACAGCCT<br>GGACATCAAGTGGTGA | |
| LDLRAD3<br>-><br>ANK3 | ATGTGGCTGCTGGGGCCGCTGTGCCTGCTGCTGAGCAGCGCCGCGGAGAG<br>CCAGCTGCTCCCCGGGAACAACTTCACCAATGAGTGCAACATACCAGGCA<br>ACTTCATGTGCAGCAATGGACGGTGCATCCCGGGCGCCTGGCAGTGTGAC<br>GGGCTGCCTGACTGCTTCGACAAGAGTGATGAGAAGGAGTGCCTCTGATG<br>CCAATGCAAGTTACTTAAGAGCAGCTCGAGCTGGACACCTTGAAAAGGC<br>CCTCGACTACATAAAAAATGGAGTTGACATCAACATTTGCAATCAGAATG<br>GGTTGAACGCTCTCCACCTTGCTTCCAAAGAAGGCCATGTAGAGGTTGTT<br>TCTGAGCTGCTGCAGAGAGAAGCCAATGTGGATGCAGCTACAAAGAAAG<br>GAAACACAGCATTGCACATCGCATCTTTGGCTGGGCAAGCAGAGGTGGT<br>AAAAGTCTTGGTTACAAATGGAGCCAATGTCAATGCACAATCTCAGAATG<br>GTTTCACGCCATTGTATATGGCAGCCCAGGAAAATCACCTGGAAGTTGTC<br>AAGTTTCTTCTTGACAATGGTGCAAGCCAGAGCCTAGCCACAGAGGATGG<br>CTTCACACCATTGGCAGTGGCTTTGCAACAAGGTCACGACCAAGTCGTTT<br>CGCTCCTGCTAGAGAATGACACCAAAGGAAAAGTGCGTCTCCCAGCTCTT<br>CATATCGCGGCCCGAAAAGACGACACGAAAGCCGCCGCCCTGCTGCTGC<br>AGAATGACAACAATGCAGATGTGGAATCAAAGAGTGGCTTCACTCCGCT<br>CCACATAGCTGCTCACTATGGAAATATCAATGTAGCCACGTTGCTGTTAA<br>ACCGAGCGGCTGCTGTGGATTTCACCGCAAGGAATGACATCACTCCTTTA<br>CATGTTGCATCAAAAAGAGGAAATGCAAATATGGTAAAACTATTGCTCG<br>ATCGAGGAGCTAAAATCGATGCCAAAACCAGGGATGGTCTGACACCACT<br>GCACTGTGGAGCAAGGAGTGGCCACGAGCAGGTGGTAGAAATGTTGCTT<br>GATCGAGCTGCCCCCATTCTTTCAAAAACCAAGAATGGATTATCTCCATT<br>GCACATGGCCACACAAGGGGATCATTTAAACTGCGTCCAGCTTCTCCTCC<br>AGCATAATGTACCCGTGGATGATGTCACCAATGACTACCTGACTGCCCTA<br>CACGTGGCTGCCCACTGTGGCCATTACAAAGTTGCCAAGGTTCTCTTGGA<br>TAAGAAAGCTAACCCCAATGCCAAAGCCCTGAATGGCTTTACCCCTCTTC<br>ATATTGCCTGCAAGAAGAATCGAATTAAAGTAATGGAACTCCTTCTGAAA<br>CACGGTGCATCCATCCAAGCTGTAACCGAGTCGGGCCTTACCCCAATCCA<br>TGTTGCTGCCTTCATGGGGCATGTAAATATTGTATCACAACTAATGCATC<br>ATGGAGCCTCACCAAACACCACCAATGTGAGAGGAGAAACAGCACTGCA<br>CATGGCAGCTGCTCCGGCCAAGCTGAAGTTGTGCGGTATCTGGTACAAG<br>ACGGAGCTCAGGTAGAAGCTAAAGCTAAGGATGACCAAACACCACTCCA<br>CATTTCAGCCCGACTGGGGAAAGCAGACATAGTACAACAGCTGTTGCAG<br>CAAGGGGCATCTCCAAATGCAGCCACAACTTCTGGGTACACCCCACTTCA<br>CCTTTCCGCCCGAGAGGGCATGAGGATGTGGCCGCGTTCCTTTTGGATC<br>ATGGAGCGTCTTTATCTATAACAACAAAGAAAGGATTTACTCCTCTTCAT<br>GTGGCAGCAAAATATGGAAAGCTTGAAGTCGCCAATCTCCTGCTACAGA<br>AAAGTGCATCTCCAGATGCTGCTGGGAAGAGCGGGCTAACACCACTGCA<br>TGTAGCTGCACATTACGATAATCAGAAAGTGGCCCTTCTGCTTTTGGACC<br>AAGGAGCCTCACCTCACGCAGCCGCAAAGAATGGTTATACGCCACTGCA<br>CATCGCTGCCAAAAAGAACCAGATGGACATAGCGACAACTCTGCTGGAA<br>TATGGTGCTGATGCCAACGCAGTTACCCGGCAAGGAATTGCTTCCGTCCA<br>TCTCGCAGCTCAGGAAGGGCACGTGGACATGGTGTCGCTGCTCCTCGGTA<br>GAAATGCGAATGTGAACCTGAGCAATAAGAGCGGCCTGACCCCACTCCA<br>TTTGGCTGCTCAAGAAGATCGAGTGAATGTGGCAGAAGTCCTCGTAAACC<br>AAGGGGCTCATGTGGACGCCCAGACAAAGATGGGATACACACCACTGCA<br>TGTGGGCTGCCACTATGAAATATCAAGATTGTTAATTTCCTGCTCCAGC<br>ATTCTGCAAAAGTTAATGCCAAACAAAGAATGGGTATACGCCATTACAT<br>CAAGCAGCACAGCAGGGGCATACGCATATAATAAATGTCTTACTTCAGA<br>ACAACGCCTCCCCAATGAACTCACTGTGAATGGGAATACTGCCCTTGCA<br>ATTGCCCGGCGCCTCGGCTACATCTCAGTAGTGGACACCCTGAAGATAGT<br>GACCGAAGAGACCATGACCACAACTACTGTCACAGAGAAGCACAAAATG<br>AATGTTCCAGAAACGATGAATGAAGTTCTTGATATGTCTGATGATGAAGT<br>TCGTAAAGCCAATGCCCCTGAAATGCTCAGTGATGGCGAATATATCTCAG<br>ATGTTGAAGAAGGTGAAGATGCAATGACCGGGGACACAGACAAATATCT | SEQ ID NO: 55 |

| Gene Fusion | Chimera Sequence | SEQ ID NO. |
|---|---|---|
| | TGGGCCACAGGACCTTAAGGAATTGGGTGATGATTCCCTGCCTGCAGAGG<br>GTTACATGGGCTTTAGTCTCGGAGCGCGTTCTGCCAGCCTCCGCTCCTTCA<br>GTTCGGATAGGTCTTACACCTTGAACAGAAGCTCCTATGCACGGGACAGC<br>ATGATGATTGAAGAACTCCTTGTGCCATCCAAAGAGCAGCATCTAACATT<br>CACAAGGGAATTTGATTCAGATTCTCTTAGACATTACAGCTGGGCTGCAG<br>ACACCTTAGACAATGTCAATCTTGTTTCAAGCCCCATTCATTCTGGGTTTC<br>TGGTTAGCTTTATGGTGGACGCGAGAGGGGGCTCCATGAGAGGAAGCCG<br>TCATCACGGGATGAGAATCATCATTCCTCCACGCAAGTGTACGGCCCCCA<br>CTCGAATCACCTGCCGTTTGGTAAAGAGACATAAACTGGCCAACCCACCC<br>CCCATGGTGGAAGGAGAGGGATTAGCCAGTAGGCTGGTAGAAATGGGTC<br>CTGCAGGGGCACAATTTTTAGGCCCTGTCATAGTGGAAATCCCTCACTTT<br>GGGTCCATGAGAGGAAAAGAGAGAGAACTCATTGTTCTTCGAAGTGAAA<br>ATGGTGAAACTTGGAAGGAGCATCAGTTTGACAGCAAAAATGAAGATTT<br>AACCGAGTTACTTAATGGCATGGATGAAGAACTTGATAGCCCAGAAGAG<br>TTAGGGAAAAAGCGTATCTGCAGGATTATCACGAAAGATTTCCCCCAGTA<br>TTTTGCAGTGGTTTCCCGGATTAAGCAGGAAAGCAACCAGATTGGTCCTG<br>AAGGTGGAATTCTGAGCAGCACCACAGTGCCCCTTGTTCAAGCATCTTTC<br>CCAGAGGGTGCCCTAACTAAAAGAATTCGAGTGGGCCTCCAGGCCCAGC<br>CTGTTCCAGATGAAATTGTGAAAAAGATCCTTGGAAACAAAGCAACTTTT<br>AGCCCAATTGTCACTGTGGAACCAAGAAGACGGAAATTCCATAAACCAA<br>TCACAATGACCATTCCGGTGCCCCCGCCCTCAGGAGAAGGTGTATCCAAT<br>GGATACAAAGGGGACACTACACCCAATCTGCGTCTTCTCTGTAGCATTAC<br>AGGGGGCACTTCGCCTGCTCAGTGGGAAGACATCACAGGAACAACTCCTT<br>TGACGTTTATAAAGATTGTGTCTCCTTTACAACCAATGTTTCAGCCAGAT<br>TTTGGCTTGCAGACTGCCATCAAGTTTTAGAAACTGTGGGGTTAGCCACG<br>CAACTGTACAGAGAATTGATATGTGTTCATATATGGCCAAGTTTGTTGTT<br>TTTGCCAAAATGAATGATCCCGTAGAATCTTCCTTGCGATGTTTCTGCATG<br>ACAGATGACAAAGTGGACAAAACTTTAGAGCAACAAGAGAATTTTGAGG<br>AAGTCGCAAGAAGCAAAGATATTGAGGTTCTGGAAGGAAAACCTATTTA<br>TGTTGATTGTTATGGAAATTTGGCCCCACTTACCAAAGGAGGACAGCAAC<br>TTGTTTTTAACTTTTATTCTTTCAAAGAAAATAGACTGCCATTTTCCATCA<br>AGATTAGAGACACCAGCCAAGAGCCCTGTGGTCGTCTGTCTTTTCTGAAA<br>GAACCAAAGACAACAAAAGGACTGCCTCAAACAGCGGTTTGCAACTTAA<br>ATATCACTCTGCCAGCACATAAAAAGGAGACAGAGTCAGATCAAGATGA<br>TGAGATTGAGAAAACAGATAGACGACAGAGCTTCGCATCCTTAGCTTTAC<br>GTAAGCGCTACAGCTACTTGACTGAGCCTGGAATGATTGAACGGAGTACA<br>GGAGCAACAAGATCCCTCCCCACCACTTACTCATACAAGCCATTCTTTTCT<br>ACAAGACCATACCAGTCCTGGACAACAGCTCCGATTACAGTGCCTGGGCC<br>AGCCAAGTCAGGCTTCACTTCCTTATCAAGTTCTTCCTCTAATACGCCATC<br>AGCTTCTCCGTTAAAATCAATATGGTCTGTTTCGACACCTTCTCCAATCAA<br>ATCCACATTAGGCGCGTCAACTACATCTTCAGTTAAATCCATTAGTGACG<br>TGGCATCTCCAATTAGATCCTTTCGGACAATGTCTTCGCCGATAAAAACT<br>GTGGTGTCACAATCTCCATACAATATCCAAGTTTCCTCTGGTACCCTGGCT<br>AGAGCTCCAGCAGTCACGGAAGCTACGCCCTTAAAAGGGCTGGCATCCA<br>ATTCTACGTTTTCCTCTCGAACCTCTCCAGTGACTACAGCAGGGTCTCTTT<br>TGGAGAGGTCATCAATTACTATGACACCCCCTGCCTCCCCCAAATCAAAC<br>ATTAATATGTATTCCTCAAGTTTGCCATTTAAGTCAATTATTACATCAGCA<br>GCACCGCTAATATCTTCACCTTTAAAGTCAGTGGTGTCTCCAGTTAAATCA<br>GCAGTTGATGTCATTTCATCAGCCAAAATTACAATGGCATCTTCTCTCTCA<br>TCACCTGTGAAGCAGATGCCTGGACATGCAGAGGTAGCATTAGTCAATGG<br>ATCTATTTCCCCTCTAAAATATCCATCATCCTCAACTTTAATTAATGGATG<br>CAAAGCCACTGCCACGTTACAGGAAAAAATTTCTTCTGCTACAAACTCTG<br>TGAGCTCTGTGGTCAGTGCAGCCACTGACACAGTGAGAAAGTGTTTTCT<br>ACCACGACTGCAATGCCATTTTCCCCACTCAGGTCATATGTTTCTGCAGCA<br>CCATCAGCTTTTCAGTCTCTAAGAACTCCTTCCGCAAGTGCACTCTATACA<br>TCCCTTGGGTCGTCAATATCTGCAACTACCTCATCTGTAACTTCATCAATT<br>ATAACAGTGCCAGTATACTCTGTAGTCAATGTTTTGCCAGAACCAGCATT<br>AAAGAAACTTCCAGACTCTAATTCATTTACAAAATCAGCAGCAGCCTTGC<br>TGTCACCCATTAAAACATTGACTACGGAGACACATCCTCAGCCTCACTTC<br>AGTCGAACTTCATCTCCAGTTAAGTCATCTTTGTTCCTTGCACCCTCTGCC<br>CTTAAGTTGTCTACACCATCTTCTTTATCTTCCAGTCAGGAGATACTAAAA<br>GATGTAGCTGAAATGAAAGAGGACCTAATGCGGATGACCGCAATACTAC<br>AGACAGATGTGCCTGAGGAGAAGCCATTCCAACCTGAACTCCCAAAGGA<br>AGGGAGAATAGATGATGAAGAACCTTTCAAAATTGTAGAGAAAGTAAAG<br>GAAGACTTAGTGAAAGTTAGTGAAATCCTTAAAAAGGATGTATGTGTAG<br>ATAATAAAGGATCACCCAAATCACCAAAGAGTGACAAAGGACACTCTCC<br>TGAAGATGACTGGATAGAATTTAGTTCGGAAGAAATCCGGGAAGCCAGA<br>CAACAAGCTGCTGCGAGCCAGTCTCCATCTCTGCCAGAGAGTGCAAGT<br>AAAAGCAAAAGCCGCCTCCGAAAAGGATTATAACTTGACCAAAGTTATT<br>GATTACCTAACAAATGATATTGGGAGTAGTTCACTGACAAACTTAAATA<br>CAAGTTTGAGGATGCAAAGAAGGATGGTGAGGAGAGACAGAAAAGAGTT<br>TTAAAACCAGCAATTGCTTTGCAGGAACACAAACTCAAAATGCCTCCAGC<br>CTCCATGAGGACTTCCACCTCTGAGAAAGAATTGTGTAAAATGGCTGATT<br>CCTTTTTTGGAACAGATACTATTTTAGAGTCTCCTGATGACTTTTCTCAAC<br>ACGACCAAGATAAAAGTCCCTTGTCTGACAGTGGCTTTGAAACAAGAAGT<br>GAAAAGACACCTTCAGCCCCACAAAGCGCTGAAAGCACTGGTCCTAAAC<br>CACTTTTTCATGAAGTTCCCATCCCTCCTGTCATTACAGAAACAAGAACTG | |

TABLE B-continued

| Gene Fusion | Chimera Sequence | SEQ ID NO. |
|---|---|---|
| | AAGTGGTTCATGTTATCAGGAGCTATGATCCCTCAGCTGGGGATGTTCCC<br>CAGACCCAACCAGAGGAGCCTGTGTCACCTAAACCTTCACCTACTTTTAT<br>GGAATTGGAACCAAAGCCCACCACCTCTAGTATTAAAGAAAAGGTTAAA<br>GCATTTCAAATGAAAGCCAGTAGTGAAGAAGATGACCACAATCGGGTTTT<br>AAGCAAAGGCATGCGTGTTAAAGAAGAGACTCACATAACCACAACCACC<br>AGAATGGTTTATCATTCTCCACCAGGCGGTGAAGGTGCATCTGAAAGAAT<br>TGAAGAAACCATGTCAGTCCATGACATCATGAAGGCCTTTCAGTCCGGGC<br>GGGATCCTTCCAAAGAACTGGCAGGTCTGTTTAACATAAGTCGGCAGTG<br>TCTCCAGATGTTCACAAGTCTGCTGCTGAAACCTCAGCCCAGCATGCAGA<br>GAAGGACAACCAAATGAAACCCAAACTGGAGCGTATAATAGAAGTCCAC<br>ATCGAAAAGGTAACCAAGCTGAGCCCACTGAAGTCATTATTAGAGAAA<br>CCAAAAAGCATCCAGAAAAGAAATGTATGTATATCAGAAAGACTTATC<br>CCGGGGAGATATTAACCTAAAAGATTTTCTGCCAGAAAAACACGATGCTT<br>TTCCTTGTTCAGAGGAACAGGGTCAGCAAGAAGAAGAAGAACTTACTGC<br>TGAAGAGTCATTGCCTTCTTATCTGGAGTCTTCCAGAGTAAACACTCCTGT<br>GTCCCAAGAAGAAGATAGCCGCCCTAGTTCTGCTCAACTCATATCTGATG<br>ACTCTTATAAAACATTGAAGCTTTTGAGTCAACACTCAATAGAATACCAT<br>GACGATGAGTTGTCAGAACTAAGAGGGGAGTCTTACAGGTTTGCTGAGA<br>AAATGCTTCTGTCAGAAAAGCTAGATGTGTCTCATTCTGATACTGAGGAA<br>TCGGTTACAGACCATGCAGGACCCCCTAGCTCAGAGTTACAGGGGTCTGA<br>TAAGCGGTCCAGAGAAAAAATAGCCACTGCCCCCAAAAAAGAAATTCTC<br>TCCAAAATCTATAAAGATGTTTCTGAAAATGGTGTAGGTAAAGTGTCTAA<br>AGATGAGCATTTTGATAAAGTGACAGTGTTGCACTATTCTGGCAATGTTA<br>GTAGTCCAAAACATGCCATGTGGATGCGCTTTACTGAGGACAGATTAGAC<br>AGAGGTAGAGAGAAGTTGATATATGAAGATAGGGTGGACAGGACTGTGA<br>AGGAGGCTGAAGAAAAACTGACTGAAGTGTCACAGTTTTTTCGTGACAA<br>AACTGAAAAGCTAAATGATGAACTGCAGTCCCCAGAGAAAAAGGCACGC<br>CCTAAAAATGGCAAAGAATATTCTTCTCAAAGCCCTACCAGTAGCAGCCC<br>TGAGAAAGTGCTACTGACAGAACTGCTGGCATCCAATGATGAGTGGGTTA<br>AGGCAAGACAGCATGGCCCTGATGGACAAGGCTTCCCCAAGGCCGAGGA<br>GAAGGCACCCAGTCTGCCCAGCAGCCCAGAGAAGATGGTTCTCTCCCAAC<br>AGACTGAGGACAGCAAGTCCACAGTGGAAGCCAAAGGAAGTATTTCACA<br>GAGCAAAGCACCAGATGGGCCCCAGTCTGGATTCCAGCTCAAACAATCT<br>AAACTCAGTTCCATTAGATTAAAATTTGAACAAGGCACACACGCAAAAA<br>GTAAGGACATGTCTCAAGAAGACAGAAAGTCAGATGGCCAGTCCAGAAT<br>CCCAGTTAAAAAAATACAGGAGAGCAAGCTACCCGTCTACCAAGTTTTTG<br>CTAGAGAAAAACAGCAGAAGGCCATAGACCTCCCAGATGAAAGTGTATC<br>TGTGCAAAAAGATTTTATGGTATTAAAAACCAAAGATGAGCATGCCCAA<br>AGCAACGAAATTGTTGTAAATGATTCTGGCTCTGATAATGTGAAAAAACA<br>GAGAACTGAAATGTCAAGTAAAGCAATGCCTGACTCTTTTTCTGAGCAGC<br>AGGCTAAAGACTTGGCATGTCATATAACCTCAGATTTAGCAACTAGGGGA<br>CCATGGGACAAAAAGGTCTTTAGAACATGGGAGAGTTCGGGAGCCACTA<br>ACAATAAGTCTCAGAAAGAAAAACTTTCGCATGTACTTGTTCATGATGTA<br>AGAGAGAATCACATTGGTCACCCTGAGAGTAAAAGTGTTGATCAAAAGA<br>ATGAATTTATGTCTGTGACTGAGAGAGAACGCAAATTGTTAACAAACGGC<br>TCTCTCTCAGAAATTAAAGAAATGACTGTAAAATCTCCCTCCAAAAAAGT<br>CTTATATAGGGAATATGTTGTGAAAGAAGGGGACCATCCAGGCGGATTG<br>CTTGATCAGCCTTCCAGGAGGAGCGAGAGCTCAGCAGTGTCACACATTCC<br>CGTCAGAGTTGCTGATGAGAGGAGAATGCTGTCTTCTAATATTCCCGATG<br>GTTTTTGTGAACAGTCGGCATTTCCAAAACATGAACTATCACAAAAATTG<br>TCCCAGTCAAGCATGAGTAAAGAGACAGTTGAGACACAGCACTTTAATTC<br>TATAGAAGATGAAAAAGTTACCTATTCAGAAATCAGCAAAGTTTCCAAAC<br>ACCAGAGTTATGTAGGTTTATGCCCACCTCTCGAGGAAACCGAAACCTCC<br>CCCACCAAATCTCCTGATTCTTTAGAGTTTAGCCCAGGAAAGGAATCTCC<br>CTCTAGTGATGTATTCGACCACAGTCCCATTGATGGATTGGAAAAACTCG<br>CACCACTAGCCCAGACAGAGGGAGGGAAAGAGATAAAAACTTTACCCGT<br>TTATGTCAGTTTTGTACAAGTGGGGAAGCAATATGAAAAGGAGATACAA<br>CAAGGAGGTGTAAAAAAAATCATAAGTCAGGAATGTAAGACAGTACAAG<br>AAACCAGGGGGACCTTTTATACAACTAGACAGCAAAAGCAACCTCCTTCT<br>CCCCAAGGTAGTCCAGAAGATGATACTCTAGAGCAAGTATCCTTTCTAGA<br>CAGCTCTGGGAAAAGCCCTTTAACCCCAGAAACACCCAGTTCAGAGGAA<br>GTGAGTTATGAATTTACATCTAAGACACCTGACTCGCTCATAGCTTATAT<br>ACCAGGCAAACCCAGCCCAATTCCCGAGGTTTCTGAGGAGTCAGAGGAG<br>GAGGAACAGGCCAAGTCAACCTCCCTTAAGCAGACTACAGTGGAGGAAA<br>CAGCAGTTGAGCGTGAAATGCCTAATGACGTGAGCAAAGACTCTAACCA<br>AAGACCCAAAATAACAGAGTTGCCTATATTGAATTTCCCCCTCCTCCAC<br>CACTGGATGCGGACCAGATTGAGTCAGATAAGAAGCATCATTATCTCCCA<br>GAAAAAGAGGTTGACATGATTGAAGTCAATCTGCAAGATGAGCATGACA<br>AGTACCAGCTGGCTGAACCTGTCATTAGAGTGCAGCCACCTTCACCAGTT<br>CCTCCCGGGGCAGACGTCAGTGATTCAAGCGATGACGAATCTATTTATCA<br>GCCAGTCCCAGTTAAAAAATACCTTCAAATTAAAGGAAGTGGACGAT<br>GAACAAAAAGAAAACCCAAAGCTTCTGCTGAAAAGGCTTCCAACCAGA<br>AAGAACTGGAAAGTAATGGATCTGGAAAAGATAATGAATTTGGCCTTGG<br>CCTTGATTCACCTCAGAATGAAATTGCCCAGAATGGGAACAACGACCAGT<br>CCATCACAGAGTGTTCCATTGCCACCACAGCAGAGTTTTCTCATGACACG<br>GATGCCACAGAGATCGACTCTCTGGATGGCTATGACCTGCAAGATGAAG<br>ATGATGGCTTGACAGAGAGTGATTCTAAACTCCCAATTCAAGCCATGGAA | |

TABLE B-continued

| Gene Fusion | Chimera Sequence | SEQ ID NO. |
|---|---|---|
| | ATTAAGAAAGATATCTGGAACACAGAGGGCATTCTGAAGCCAGCTGACC GCTCTTTTAGCCAAAGTAAACTTGAAGTTATCGAGGAGGAGGGAAAGGT GGGACCAGATGAGGACAAGCCACCTTCTAAAAGTTCTTCATCTGAAAAG ACTCCTGATAAGACTGATCAGAAGTCAGGGGCCCAGTTCTTCACACTGGA AGGCAGACATCCTGACAGATCAGTGTTTCCTGATACTTACTTCAGTTACA AAGTAGATGAAGAATTTGCCACTCCTTTTAAAACAGTAGCTACCAAAGGT CTAGATTTTGACCCTTGGTCTAATAACCGAGGGGATGATGAAGTTTTTGA CAGTAAATCACGGGAAGATGAAACTAAGCCATTTGGGCTGGCGGTAGAA GACCGCTCTCCAGCAACAACCCCTGATACAACGCCAGCCAGAACGCCAA CTGATGAAAGTACCCCAACTAGTGAGCCTAACCCCTTCCCATTTCATGAA GGAAAAATGTTTGAGATGACTCGCAGTGGTGCAATTGACATGAGCAAGA GGGATTTTGTTGAAGAGAGGCTCCAATTTTTCCAGATTGGTGAGCATACT TCTGAAGGGAAGTCAGGGGACCAGGGGGAAGGGGATAAAAGTATGGTCA CTGCCACACCACAGCCACAGTCAGGGGACACCACTGTAGAAACCAATCT AGAGAGAAATGTAGAGACACCTACAGTGGAACCTAACCCCAGCATCCCG ACCAGCGGAGAGTGTCAGGAAGGCACATCCAGTAGTGGCTCCCTGGAGA AATCAGCAGCAGCCACTAACACCTCTAAAGTTGACCCCAAGTTGCGCACG CCTATAAAAATGGGAATTTCTGCATCCACCATGACCATGAAGAAAGAAG GCCCTGGAGAAATAACAGATAAGATAGAAGCGGTGATGACCAGTTGTCA GGGATTAGAAAATGAACTATAACAATGATTTCAAATACAGCCAATAGC CAGATGGGCGTTAGGCCCCATGAAAAACATGATTTTCAAAAAGATAACTT TAATAACAACAACAATTTGGATTCTTCCACTATACAGACAGATAACATTA TGAGTAATATAGTTCTGACAGAACATTCTGCACCCACTTGTACCACAGAG AAAGATAACCCAGTGAAAGTCTCATCAGGAAAAAAGACAGGGGTACTAC AAGGACACTGTGTAAGAGATAAGCAGAAAGTTCTTGGAGAACAGCAAAA AACAAAGGAATTGATAGGGATTAGGCAAAAATCCAAACTTCCCATAAAG GCCACTTCACCAAAAGATACCTTCCCACCGAACCATATGTCAAACACTAA AGCAAGTAAAATGAAGCAGGTTAGTCAATCCGAGAAAACCAAAGCCCTT ACTACTTCTTCATGTGTAGATGTAAAGTCCAGAATTCCAGTGAAAAACAC ACACAGGGATAACATAATTGCAGTTAGAAAAGCATGTGCCACACAAAAG CAAGGGCAGCCAGAGAAAGGCAAGGCCAAACAGCTTCCATCCAAGTTGC CAGTAAAGGTAAGATCCACCTGTGTCACTACCACCACCACCACTGCCACC ACCACCACCACTACCACCACTACCACCACCACCAGCTGCACAGTTAAAGT TAGGAAAAGTCAGCTCAAGGAAGTATGTAAACATTCCATTGAATATTTTA AGGGAATTAGTGGTGAGACCTTAAAGCTTGTGGACCGCCTCTCTGAAGAA GAAAAAAAGATGCAGTCCGAGTTGTCCGATGAGGAAGAAAGTACCTCAA GAAACACGTCGTTGTCCGAGACTTCCCGGGGTGGCCAGCCTTCGGTTACA ACGAAGTCTGCTAGAGATAAGAAAACAGAGGCAGCACCTTTAAAATCAA AGAGTGAAAAGGCCGGCAGTGAGAAAAGGAGCAGTAGAAGGACTGGTC CACAGAGTCCATGTGAACGGACAGATATCAGGATGGCAATAGTAGCCGA TCACCTGGGACTTAGTTGGACAGAACTGGCAAGGGAACTGAATTTTTCAG TGGATGAAATCAATCAAATACGTGTGGAAATCCAAATTCTTTAATTTCT CAGAGCTTCATGTTATTAAAAAAATGGGTTACCAGAGACGGAAAAAATG CCACAACTGATGCCTTAACTTCGGTCTTGACAAAAATTAATCGAATAGAT ATAGTGACACTGCTAGAAGGACCAATATTTGATTATGGAAATATTTCAGG CACCAGAAGTTTTGCAGATGAGAACAATGTTTTCCATGACCCTGTTGATG GTTGGCAGAATGAGACATCAAGTGGAAACCTAGAGTCCTGCGCTCAAGC TCGAAGAGTAACTGGTGGGTTACTAGATCGACTGGATGACAGCCCTGACC AGTGTGTAGAGATTCCATTACCTCATATCTCAAAGGAGAAGCTGGCAAATTT GAAGCAAATGGAAGCCATACAGAAATCACTCCAGAAGCAAAGACAAAAT CTTACTTTCCAGAATCCCAAAATGATGTAGGAAAAACAGAGTACCAAGGA AACTCTGAAACCAAAAATACATGGATCTGGTCATGTTGAAGAACCAGCAT CACCACTAGCAGCATATCAGAAATCTCTAGAAGAAACCAGCAAGCTTAT AATAGAAGAGACTAAACCCTGTGTGCCTGTCAGTATGAAAAAGATGAGT AGGACTTCTCCAGCAGATGGCAAGCCAAGGCTTAGCCTCCATGAAGAAG AGGGGTCCAGTGGGTCTGAGCAAAAGCAGGGAGAAGGTTTTAAGGTGAA AACGAAGAAAGAAATCCGGCATGTGAAAAGAAGAGCCACTCGTAA | |
| THOC2 -> DOCK11 | ATGGCGGCCGCGGCTGTGGTGGTTCCCGCAGAGTGGATAAAGAACTGGG AGAAATCAGGGAGAGGCGAATTTTTGCATTTATGTCGGATCCTCAGTGAA AATAAAAGCCATGATAGTTCAACATACAGAGATTCCAGCAAGCTCTCTA TGAGTTGTCATATCATGTAATTAAAGGAAATCTAAAGCATGAACAGGCAT CTAATGTTCTTAGTGACATTAGTGAATTTCGTGAGGATATGCCCTCCATTC TTGCTGATGTATTCTGCATATTAGACATTGAGACAAATTGTTTAGAAGAA AAAAGCAAGAGAGACTATTTTACACAGTTGGTATTAGCATGTTTGTATTT AGTTTCAGACACAGTTCTAAAGGAACGCCTGGATCCAGAAACACTGGAA TCATTAGGGCTTATCAAACAATCACAGCAATTCAATCAAAGTCAGTTAA AATCAAGACAAAACTCTTTTATAAGCAGCAAAAATTCAATTTGTTAAGAG AAGAGAATGAAGGTTATGCCAAGCTGATTGCTGAATTGGGCAAGATTT ATCTGGAAGTATTACTAGTGATTAATCTTAGAAAATATCAAATCTTTAAT AGGATGCTTTAATCTGGATCCCAATAGAGTTTTGGATGTCATTTTAGAAG TGTTTGAATGCAGGCCAGAACACGATGACTTCTTTATATCTTTGTTAGAAT CTTACATGAGTATGTGTGAACCGCAAACACTGTGTCATATTCTTGGGTTC AAATTCAAGTTTTACCAGGAACCAAATGGCGAGACACCATCATCTTTATA CAGAGTTGCAGCAGTACTTCTACAATTTAATCTTATTGATTTAGATGATCT TTATGTACATCTTCTTCCGGCTGATAATTGCATTATGGATGAACACAAAC GAGAAATTGCGGAAGCTAAGCAAATTGTTAGAAAGCTTACGATGGTTGT | SEQ ID NO: 56 |

TABLE B-continued

| Gene Fusion | Chimera Sequence | SEQ ID NO. |
|---|---|---|
| | GTTGTCTTCTGAAAAAATGGATGAGCGAGAGAAAGAAAAGGAAAAAGAA<br>GAGGAGAAAGTAGAGAAACCACCTGATAACCAAAAACTTGGCTTGTTGG<br>AAGCCTTATTAAAGATTGGTGATTGGCAACATGCACAGAACATTATGGAT<br>CAGATGCCTCCATACTATGCAGCTTCACACAAGCTAATAGCCCTTGCTAT<br>TTGCAAGCTCATTCATATAACTATTGAGCCTCTCTACCGAAGAGTTGGAG<br>TTCCTAAAGGTGCTAAAGGCTCACCTGTTAATGCTTTGCAAAACAAGAGA<br>GCACCAAAACAAGCTGAGAGCTTTGAAGATTTGAGGAGAGACGTGTTCA<br>ATATGTTCTGTTACCTTGGTCCTCACCTTTCTCACGATCCCATTTTATTTGC<br>AAAAGTGGTGCGCATAGGCAAGTCATTTATGAAGGAGGAAAAGGCCAAA<br>GTTGTTGAGCCCCTGGACTATGAGAATGTTATTGCCCAAAGAAAAACCCA<br>GATTTACAGCGACCCCCTCCGAGATCTGCTTATGTTCCCAATGGAAGATA<br>TATCTATCTCGGTGATAGGTCGTCAACGCAGAACGGTGCAGTCTACTGTA<br>CCAGAAGATGCTGAAAAGAGGGCCCAGAGTTTATTTGTTAAAGAGTGTAT<br>TAAAACCTATAGCACAGATTGGCACGTGGTAAACTACAAGTATGAGGAC<br>TTCTCTGGGGACTTTCGAATGTTGCCATGTAAATCTTTGAGACCAGAAAA<br>GATTCCTAATCATGTATTTGAGATAGATGAAGACTGTGAGAAAGATGAGG<br>ACTCATCTTCTTTATGTTCTCAGAAGGGTGGTGTGATAAAACAAGGCTGG<br>TTGCATAAAGCAAATGTAAATAGTACCATCACAGTAACCATGAAGGTATT<br>CAAGAGACGATATTTTTACTTGACCCAACTTCCTGACGGTTCATATATTCT<br>CAATTCCTATAAAGATGAGAAAAATTCAAAAGAATCGAAAGGTTGCATC<br>TACTTGGACGCCTGCATTGATGTTGTTCAGTGCCCCAAAATGCGCCGTCA<br>TGCTTTTGAACTCAAGATGTTAGATAAATATAGCCATTATCTGGCTGCTG<br>AAACTGAGCAGGAAATGGAGGAATGGTTGATAACTTTGAAAAAGATTAT<br>TCAGATCAACACCGACAGTTTAGTTCAAGAAAAAAAGGAGACGGTAGAA<br>ACAGCACAAGATGATGAAACTAGCAGCCAAGGAAAAGCCGAGAACATCA<br>TGGCAAGTTTGGAAAGGAGCATGCATCCGGAACTGATGAAGTATGGAAG<br>AGAAACTGAACAACTAAACAAACTCAGTAGAGGAGATGGAAGACAGAAT<br>CTCTTTTCTTTTGATTCAGAAGTTCAGAGGTTGGACTTTTCAGGAATTGAA<br>CCTGATATAAAGCCATTTGAAGAAAAATGCAATAAACGTTTCCTGGTGAA<br>TTGCCATGATTTAACTTTCAATATCTTGGGCCAAATTGGAGACAATGCAA<br>AAGGACCACCCACAAATGTTGAGCCCTTTTTTATCAATCTTGCCTTATTTG<br>ATGTAAAGAACAATTGTAAGATTTCAGCAGACTTTCATGTAGACCTGAAT<br>CCCCCATCTGTCCGTGAAATGCTGTGGGGCTCTTCAACCCAACTGGCCAG<br>TGACGGTAGCCCAAAGGGCTCTTCACCCGAATCTTACATTCATGGAATTG<br>CCGAATCTCAGTTACGCTACATACAACAGGGAATTTTCTCAGTGACGAAT<br>CCACATCCTGAAATTTTTCTAGTTGCCAGAATTGAAAAGGTACTACAGGG<br>AAACATTACACACTGTGCAGAACCCTATATCAAAAATTCTGATCCAGTAA<br>AGACGGCCCAGAAGGTGCACAGGACAGCTAAACAAGTGTGTAGCCGCCT<br>TGGACAATACAGAATGCCCTTCGCTTGGGCTGCCAGACCCATTTTCAAAG<br>ATACTCAAGGCTCTCTTGATCTGGATGGGAGATTTTCTCCTCTGTATAAAC<br>AAGACAGTAGCAAGCTTTCAAGTGAAGCATTCTCAAGTTGCTCTCAGAA<br>TATAAGAAGCCAGAAAAGACCAAACTGCAGATTATTCCTGGGCAGCTAA<br>ACATCACAGTAGAATGTGTTCCTGTGGATTTATCAAATTGTATTACTTCTT<br>CATATGTGCCCTTGAAGCCTTTTGAAAAGAATTGCCAAAATATTACTGTG<br>GAGGTTGAAGAGTTTGTTCCAGAAATGACAAATATTGTTATCCATTTAC<br>TATTTACAAAAACCATCTGTATGTATATCCCCTGCAATTAAAATACGATA<br>GCCAGAAAACATTTGCCAAGGCAAGGAACATTGCAGTCTGTGTGGAATTC<br>CGGGATTCAGATGAAAGTGACGCTAGTGCCCTAAAGTGTATTTATGGAAA<br>ACCTGCAGGGTCTGTTTTTACCACAAATGCTTATGCTGTTGTCTCGCATCA<br>CAACCAAAATCCAGAGTTCTATGATGAGATTAAAATTGAGCTTCCCATTC<br>ACCTACATCAAAAACATCATTTGCTTTTCACTTTTTATCATGTAAGTTGTG<br>AAATTAACACAAAGGGAACAACCAAAAAGCAAGACACAGTTGAAACTCC<br>AGTTGGGTTTGCCTGGGTACCTTTGCTGAAAGATGGTAGAATCATCACAT<br>TTGAGCAGCAGCTGCCAGTTTCCGCCAATCTTCCCCCAGGCTACTTGAAT<br>CTGAATGATGCAGAATCAAGAAGGCAATGTAACGTGGATATTAAATGGG<br>TAGATGGTGCAAAGCCTTTGTTGAAGATTAAAAGCCACTTAGAATCTACC<br>ATTTACACTCAAGATCTGCATGTGCACAAATTCTTCCATCATTGCCAGCTG<br>ATTCAGTCAGGCTCGAAAGAAGTTCCAGGGGAGCTCATTAAATATTTAAA<br>GTGTTTGCATGCCATGGAGATCCAAGTCATGATACAGTTTCTACCTGTAA<br>TTCTTATGCAACTCTTCCGAGTTCTCACAAATATGACCCATGAAGATGAC<br>GTTCCTATCAACTGCACCATGGTTCTCTTACATATTGTATCAAAGTGCCAT<br>GAAGAAGGCTTGGATAGTTATCTAAGATCATTCATAAAGTATAGCTTCCG<br>ACCTGAAAAACCGAGTGCTCCTCAGGCCCAGCTGATACATGAAACCCTGG<br>CTACTACGATGATAGCAATATTGAAACAGTCTGCAGATTTTTTATCAATA<br>AACAAATTGCTAAAGTACTCATGGTTTTTCTTTGAAATAATTGCAAAGTC<br>AATGGCCACATACTTGTTGGAAGAGAATAAGATTAAGCTTCCCGAGGCC<br>AGAGATTTCCCGAGACATATCATCATGTCTTACATTCACTGCTTCTTGCAA<br>TAATTCCCCATGTGACTATTCGGTATGCGGAGATTCCCGATGAGTCCAGA<br>AATGTGAACTATAGTTTGGCTAGCTTCCTGAAGCGCTGTTTGACACTAAT<br>GGATAGAGGATTTATTTTCAATTTAATAAATGACTATATATCTGGATTCA<br>GCCCCAAAGATCCTAAGGTTCTGGCTGAATACAAGTTTGAATTTCTGCAA<br>ACAATTTGCAATCACGAACATTACATTCCTCTGAACTTGCCAATGGCATTT<br>GCAAAACCTAAACTGCAGCGGGTTCAAGATTCAAATCTTGAATACAGTTT<br>ATCAGATGAGTATTGCAAGCATCACTTCTTGGTTGGTCTACTTCTGAGGG<br>AAACTTCCATTGCTCTTCAGGACAATTATGAGATCAGATATACAGCTATC<br>TCTGTTATAAAGAATCTTTTGATAAAACATGCATTTGACACAAGATACCA<br>GCACAAGAACCAACAAGCCAAAATAGCACAATTGTACCTCCCCTTTGTTG | |

TABLE B-continued

| Gene Fusion | Chimera Sequence | SEQ ID NO. |
|---|---|---|
| | GACTACTTTTGGAAAATATACAGCGATTAGCAGGTCGAGATACCTTGTAT<br>TCTTGTGCAGCCATGCCTAATTCTGCATCCAGAGATGAGTTTCCATGTGGC<br>TTTACTTCACCTGCCAATAGAGGGAGTCTGAGCACTGACAAAGACACCGC<br>TTATGGGTCTTTTCAAAATGGACATGGAATTAAGAGAGAAGATTCAAGAG<br>GTTCCCTCATCCCAGAAGGAGCAACAGGATTTCCAGATCAGGGCAACACT<br>GGTGAAAATACCCGACAGAGTTCTACAAGGAGTAGTGTATCCCAGTATA<br>ACCGCCTGGATCAGTATGAAATCAGAAGCCTCCTGATGTGCTACCTGTAT<br>ATAGTAAAAATGATTTCAGAAGATACTCTCTTAACTTACTGGAATAAAGT<br>ATCACCTCAGGAGCTCATAAACATTCTTATACTTTTAGAAGTATGCTTGTT<br>TCACTTTAGATATATGGGGAAAAGAAACATAGCAAGGGTGCATGATGCC<br>TGGCTGTCAAAACACTTCGGAATAGACCGAAAATCGCAAACCATGCCTGC<br>TCTTCGAAACAGATCAGGAGTAATGCAGGCCCGGCTTCAGCATCTTAGTA<br>GCCTAGAAAGTTCATTTACACTTAATCACAGTTCTACAACAACTGAAGCA<br>GACATTTTCCACCAGGCACTTCTTGAAGGCAATACAGCTACTGAAGTTTC<br>CCTAACAGTACTAGACACCATATCATTTTTCACTCAGTGCTTCAAGACCC<br>AACTTTTAAATAATGATGGCCATAACCCATTAATGAAAAAAGTGTTTGAT<br>ATACATCTTGCTTTTCTTAAAAATGGACAATCTGAAGTGTCGCTGAAACA<br>TGTATTTGCCTCACTGAGAGCTTTCATCAGTAAGTTTCCTTCAGCATTTTT<br>CAAAGGAAGAGTAAACATGTGTGCTGCATTTTGCTATGAGGTTTTAAAGT<br>GCTGCACATCGAAGATTAGCTCAACCAGGAATGAAGCATCTGCACTTTTG<br>TATCTTTTGATGAGAAACAACTTTGAGTATACCAAAAGGAAAACCTTTTT<br>GAGGACACATCTACAGATAATAATTGCTGTAAGCCAACTGATAGCTGATG<br>TAGCACTAAGCGGAGGATCAAGATTTCAGGAGTCTTTATTCATTATCAAT<br>AATTTTGCAAATAGTGACAGACCTATGAAGGCAACTGCCTTTCCCGCAGA<br>AGTCAAAGACTTGACCAAGAGAATCCGCACTGTTCTTATGGCCACTGCCC<br>AAATGAAGGAGCATGAGAAAGACCCTGAAATGCTAATTGATCTCCAGTA<br>TAGCTTAGCCAAGTCCTATGCAAGCACCCCAGAGCTCAGGAAAACCTGGC<br>TTGATAGCATGGCCAAGATTCATGTAAAAAATGGAGATTTTTCAGAGGCT<br>GCGATGTGTTATGTCCATGTAGCAGCTCTAGTTGCAGAGTTTCTTCATCGA<br>AAAAAATTATTTCCTAACGGATGTTCAGCGTTCAAGAAAATTACTCCCAA<br>TATAGATGAAGAAGGAGCAATGAAAGAAGATGCTGGGATGATGGATGTC<br>CATTATAGTGAAGAGGTCTTGCTGGAGTTGCTAGAACAATGTGTGGATGG<br>CTTATGGAAGGCAGAACGTTATGAAATAATTTCTGAGATTTCCAAGTTGA<br>TCGTTCCAATTTATGAGAAACGTCGTGAGTTTGAGAAACTTACTCAAGTT<br>TATAGAACTCTTCATGGAGCTTACACAAAAATTCTGGAAGTTATGCATAC<br>AAAAAAGAGACTTTTAGGCACTTTCTTCAGAGTTGCCTTTTATGGCCAAT<br>CTTTTTTTTGAAGAAGAAGATGGAAAGGAGTACATCTATAAAGAACCAAA<br>GCTCACTGGCCTCTCAGAAATTTCCTTGAGACTTGTTAAACTTTATGGTGA<br>AAAGTTTGGTACGGAGAATGTCAAAATAATTCAGGATTCAGACAAGGTA<br>AATGCCAAAGAGCTTGATCCAAAATATGCTCATATACAAGTTACTTATGT<br>GAAGCCTTACTTTGATGACAAAGAACTCACAGAAAGGAAGACCGAGTTT<br>GAAAGAAATCATAATATCAGCAGATTTGTTTTTGAGGCCCCTTACACTTT<br>ATCAGGCAAAAACAGGGCTGTATAGAAGAACAGTGCAAACGCCGTACA<br>ATCTTGACAACTTCAAACTCGTTTCCTTACGTGAAGAAGAGGATTCCTATT<br>AACTGTGAACAGCAGATTAATTTAAAACCAATTGATGTTGCCACTGATGA<br>AATAAAAGATAAAACTGCAGAGCTGCAAAAGCTTTGCTCCTCTACTGACG<br>TGGACATGATTCAGCTCCAACTTAAATTGCAGGGCTGTGTTTCTGTGCAG<br>GTCAATGCTGGTCCATTAGCATATGCAAGAGCTTTCTTAAATGACAGCCA<br>AGCTAGCAAGTATCCACCTAAGAAAGTGAGTGAGTTGAAAGACATGTTT<br>AGGAAATTTATACAAGCATGCAGCATTGCACTTGAACTAAATGAGCGGCT<br>AATTAAAGAAGATCAAGTTGAGTACCATGAAGGGCTAAAGTCAAATTTC<br>AGAGACATGGTAAAAGAATTATCTGACATTATCCATGAGCAGATATTACA<br>AGAAGACACAATGCATTCTCCCTGGATGAGCAACACATTACATGTATTTT<br>GTGCAATTAGTGGTACATCAAGTGACCGAGGTTATGGTTCCCCAAGATAC<br>GCTGAAGTGTGA | |
| RAF1-><br>NKIRAS1 | CAGAATCGGAGAGCCGGTGGCGTCGCAGGTCGGGAGGACGAGCACCGAG<br>TCGAGGGCTCGCTCGTCTGGGCCGCCCGAGAGTCTTAATCGCGGGCGCTT<br>GGGCCGCCATCTTAGATGGCGGGAGTAAGAGGAAAACGATTGTGAGGCG<br>GGAACGGCTTTCTGCTGCTTTTTTGGGCCCCGAAAAGGGTCAGCTGGCC<br>GGGCTTTGGGGCGCGTGCCCTGAGGCGCGGAGCGCGTTTGCTACGATGCG<br>GGGGCTGCTCGGGGCTCCGTCCCCTGGGCTGGGACGCGCCGAATGTGAC<br>CGCCTCCCGCTCCCTCACCCGCCGCGGGGAGGAGGAGCGGGCGAGAAGC<br>TGCCGCCGAACGACAGGACGTTGGGGCGGCCTGGCTCCCTCAGGAATGG<br>AAGATTGCGAAACAATGGAAGATGTATACATGGCTTCAGTAGAAACAGA<br>CCGAGGAGTAAAAGAACAGTTACATCTTTATGACACCAGAGGTCTACAG<br>GAAGGCGTGGAGCTGCCAAAGCATTATTTTTCATTTGCTGATGGCTTCGTT<br>CTTGTGTACAGTGTGAATAACCTTGAATCCTTTCAAAGAGTGGGAGCTTCT<br>GAAGAAAGAAATCGATAAGTTCAAAGACAAAAAAGAGGTAGCAATTGTG<br>GTATTAGGAAACAAAATCGACCTTTCTGAGCAGAGACAAGTGGACGCTG<br>AAGTGGCACAGCAGTGGGCAAAAAGTGAGAAAGTAAGACTGTGGGAGGT<br>GACTGTTACAGATCGGAAAAATCTGATTGAACCATTCACTTTATTAGCCA<br>GTAAACTTTCTCAACCCCAGAGCAAATCAAGCTTTCCTTTGCCTGGGAGG<br>AAAAACAAAGGGAACTCTAATTCTGAGAACTAAAAATCAGTAATTTCCA<br>CAATTGTATGTTGAATAGTGATTGCCTTTAAGTGTCTGTGAACATGGAGT<br>AATATTACTATTTAAAATAGGCCATTTGTATCTACCTTTGGTCCTTAGGAA<br>AATTCCTAAGGAAGTCAATTAATGCACTTTAGATGTTAAAAGTATTTGGG | SEQ ID NO: 57 |

TABLE B-continued

| Gene Fusion | Chimera Sequence | SEQ ID NO. |
|---|---|---|
|  | CTAAGGTTATTATTGCCTGATATGAAATAATATATTCTTATTCTCATTGTT<br>TGAAACCTGTCTTTGAAATTAGCACCTTTGTTATTTATGTTGTACTTGTGA<br>AAACAGTAAAATAGTTTGGATAGTTATGCAAATGCACCTATGTGTAACTT<br>CCCCCCAACCCCAAGCTGTTTCGGAAGATATCATAATCATTCTGTGTAAC<br>ATTATGCAAACTTCTAAGCCCAAACATGACTTTGTTTTTAAAAAGTTCATT<br>AATCTAATGTCTAGGATTATAAAACATTTTTTTGTGTCTAAATTGGACCCA<br>AAACATTGAACAGTTTGGGGTAGTAAGCTAAATTTCATCTTGTGGAGATT<br>TTGCTAAACAGACTAAGACCCATGATTTAGCTTTGCTCAAATTAGAATGT<br>TTAGCATGAGTTGAGGTACCAGGTAGTGTTAAGTAGGTTCATCACGCTCT<br>AAGGCCGTTTTTTCCTTAGCCAGACCCCTGTTGATAGACCAGATACTTGA<br>GGGCAAACTGTTTGCTCCTCCTCTTGAAAATGATTAGGCACTTAAGGACA<br>GTAAAGCTGTATTTTCTGGAAGGAAGACTGTATCTTCTGGAATAGTTTTCT<br>AGAAAACTAGTCATATACAATAAAAGTATCAAAAATATTGGGCTCTAATT<br>TGATCTGACTTAGATGTCTGAGTTTGTGTTGTTTCTCTAAAGATTTTGGCA<br>AGACTCAAGCAATGTGGCTGACTGTAACTTTATTAATTTAAAAGGTAGGA<br>AGTAAGCTACTTAGTGGTTTCACCTGTGAAATAACTATTTTGACTGAAAT<br>GTAAAATAAGCTATTCAACAAAGAACATATTAAAACATCAA |  |
| ZEB1-><br>PLEKHF2 | ATGGCGGATGGCCCCAGGTGTAAGCGCAGAAAGCAGGCGAACCCGCGGC<br>GCAATAACGATGGTGGATCGCTTGGCAAACAGTGAAGCAATACTAGAC<br>GTATAAGTATAGTGGAAAACTGTTTTGGAGCAGCTGGTCAACCTTTAACT<br>ATACCTGGACGAGTTCTTATTGGAGAAGGAGTATTGACTAAGTTGTGCAG<br>GAAAAAGCCCAAAGCAAGGCAGTTTTTCTTGTTTAATGATATTCTTGTAT<br>ATGGCAATATTGTCATCCAGAAGAAAAAATATAACAAACAACATATTATT<br>CCCCTGGAAAATGTCACTATTGATTCCATCAAAGATGAGGGAGACTTAAG<br>GAATGGATGGCTAATCAAGACACCAACTAAATCTTTTGCAGTTTATGCTG<br>CCACTGCTACGGAGAAATCAGAATGGATGAATCATATAAATAAATGTGTT<br>ACTGATTTACTCTCCAAAAGTGGGAAGACACCCAGTAATGAACATGCTGC<br>TGTCTGGGTTCCTGACTCTGAGGCAACTGTATGTATGCGTTGTCAGAAAG<br>CAAAATTCACACCTGTTAATCGTCGCCACCATTGCCGCAAATGTGGTTTT<br>GTTGTCTGTGGGCCCTGCTCTGAAAAGAGATTTCTTCTTCCCAGCCAGTCC<br>TCTAAGCCTGTGCGGATTTGTGACTTCTGCTATGACCTGCTTTCTGCTGGG<br>GACATGGCCACATGCCAGCCTGCTAGATCAGACTCTTACAGCCAGTCATT<br>GAAGTCTCCTTTAAATGATATGTCTGATGATGATGACGATGATGATAGCA<br>GTGACTAA | SEQ ID NO: 58 |
| PPP1R12C<br>-><br>IFITM10 | ATGTCCGGAGAGGATGGCCCCGGCGGCTGGCCCGGGGGCGGCGGCGGCGG<br>CTGCCCGGGAGCGGCGACGGGAGCAGCTGCGGCAGTGGGGGCGCGGGC<br>GGGCGCCGAGCCTGGCCCCGGAGAGCGCCGCGCCCGCACCGTCGCTTC<br>GAGCGCGCCGCCGAGTTCCTGGCGGCTCGTGCGGGCGGCGACCTGGACG<br>AGGCGCGTCTGATGCTGCGCGCCGCCGACCCTGGCCCCGGCGCCGAGCTC<br>GACCCCGCCGCCGCCGCCCGCCCCGCGCCGTGCTGGACTCCACCAACGC<br>CGACGGTATCAGCGCCCTGCACCAGGCCTGCATTGATGAGAACCTGGAG<br>GTGGTGCGCTTCTTGGTGGAGCAGGGCGCCACTGTGAACCAGGCAGACA<br>ACGAGGGCTGGACGCCACTGCACGTGGCCGCCTCCTGTGGCTACCTAGAT<br>ATCGCCAGGTACCTCCTGAGCCACGGGGCCAACATCGCCGCCGTCAACAG<br>TGACGGGGACCTGCCCCTGGACCTGGCCGAGTCGGACGCCATGGAGGGG<br>CTGCTGAAGGCGGAGATCGCCCGCCGAGGTGTGGATGTGGAAGCAGCCA<br>AGCGGGCAGAAGAGGAATTGCTCCTTCATGACACGAGGTGCTGGCTGAA<br>TGGGGGCGCCATGCCAGAGGCCCGGCACCCCCGCACAGGCGCCTCTGCC<br>CTGCACGTGGCTGCTGCCAAGGGCTACATTGAGGTGATGAGGTTGCTCCT<br>TCAGGCTGGCTACGACCCAGAGCTCCGGGACGGGGACGGCTGGACTCCC<br>CTGCACGCAGCGGCACACTGGGGCGTGGAGGATGCCTGCCGCCTGCTGG<br>CCGAGCATGGCGGGGCATGGACTCACTGACCCATGCGGGGCAGCGTCC<br>CTGTGACCTGGCCGATGAGGAAGTACTGAGCCTGTTGGAGGAACTGGCCC<br>GGAAACAGGAGGACGCCCAGGGCCCCGGCCAGTGCCCAGCCCCGCTGGG<br>AGACCCGGCCAGCACCACGGACGGCGCCCAGGAAGCCCGAGTCCCCCTG<br>GACGGGGCCTTCTGGATTCCGAGGCCCCCGGCAGGTTCGCCCAAGGGCTG<br>CTTCGCTTGCGTGTCCAAGCCCCCTGCCCTGCAGGCTCCGGCGGCCCCTG<br>CCCCTGAGCCCTCGGCCTCTCCCCCGATGGCGCCCACACTGTTCCCCATG<br>GAGTCCAAGAGCAGCAAGACCGACAGCGTGCGGGCTGCCGGCGCGCCCC<br>CTGCCTGCAAGCACCTAGCCGAGAAGAAGACGATGACCAACCCCACGAC<br>CGTCATCGAGGTCTACCCGGACACCACCGAGGTGAACGACTATTACCTGT<br>GGTCCATCTTCAACTTCGTCTACCTCAACTTCTGCTGCCTGGGCTTCATCG<br>CCTTGGCCTACTCCCTCAAAGTGCGAGACAAGAAGCTTCTCAATGACCTG<br>AATGGAGCCGTGGAGGATGCAAAGACGGCCCGGCTGTTAACATCACCA<br>GTTCTGCCCTGGCAGCCTCCTGCATCATCCTCGTCTTCATCTTCCTGCGGT<br>ACCCCCTCACCGACTACTAA | SEQ ID NO: 59 |
| CEP152-><br>IQGAP1 | ATGTCATTAGACTTTGGCAGTGTGGCACTACCAGTGCAAAATGAAGATGA<br>AGAGTATGACGAAGAGGACTATGAAAGAGAGAAAGAGTTGCAGCAGTTA<br>CTCACAGACCTTCCCCATGACATGCTGGATGACGACCTCTCCTCTCCAGA<br>GCTCCAGTATTCGGACTGCAGCGAGGATGGCACAGACGGACAACCACAT<br>CATCCTGAGCAATTGGAGATGAGCTGGAATGAGCAAATGCTGCCCAAAT<br>CTCAAAGTGTAAATGGCTATAATGAAATTCAGAGTTTATATGCTGGAGAA<br>AAATGTGGTAATGTCTGGGAAGAAAATAGAAGTAAAACTGAAGACCGAC<br>ATCCTGTGTACCATCCTGAAGAAGGTGGAGATGAAGGTGGAAGTGGTTAT |  SEQ ID NO: 60 |

TABLE B-continued

| Gene Fusion | Chimera Sequence | SEQ ID NO. |
|---|---|---|
| | AGTCCTCCAAGTAAATGTGAACAGACTGATTTATATCACCTTCCTGAAAA<br>CTTTAGGCCATATACCAATGGTCAGAAGCAGGAATTTAATAACCAAGCAA<br>CCAATGTAATTAAATTTTCAGATCCTCAATGGAACCATTTTCAGGGTCCC<br>AGTTGTCAAGGTTTGGAACCGTATAATAAAGTGACATATAAACCTTATCA<br>GTCTTCTGCCCAGAATAATGGCTCACCAGCCCAGGAGATAACAGGAAGT<br>GACACATTCGAAGGCCTGCAACAACAATTTTTAGGAGCTAATGAGAACTC<br>TGCAGAAAATATGCAGATTATTCAACTTCAGGTTCTTAACAAAGCAAAAG<br>AGAGACAACTGGAGAACTTAATTGAAAAGTTAAATGAAAGTGAACGTCA<br>AATTCGATATCTGAATCACCAGCTTGTAATAATAAAAGATGAAAAGGATG<br>GTTTGACTCTCAGCCTTCGAGAATCACAGAAACTCTTTCAGAATGGAAAA<br>GAAAGAGAGATACAGCTTGAAGCTCAAATAAAAGCACTGGAGACTCAGA<br>TACAAGCATTAAAAGTCAATGAAGAACAGATGATCAAGAAGTCCAGAAC<br>AACTGAAATGGCTCTGGAAAGCTTGAAGCAGCAGCTGGTGGACCTTCATC<br>ATTCTGAATCACTTCAACGAGCTAGAGAACAGCATGAGAGCATTGTTATG<br>GGCCTCACAAAGAAGTACGAAGAGCAAGTATTGTCCTTACAAAAGAATT<br>TGGATGCCACAGTCACCGCACTTAAAGAACAGGAAGACATTTGCTCTCGT<br>CTGAAAGATCACGTGAAACAACTGGAAAGGAATCAAGAAGCAATCAAGT<br>TAGAAAAGACTGAGATCATTAATAAGTTGACAAGAAGTCTAGAGGAGAG<br>TCAAAAGCAGTGTGCCCACTTGTTGCAGTCCGGGTCAGTACAAGAGGTGG<br>CTCAGCTACAGTTCCAGCTGCAGCAAGCACAGAAGGCACATGCTATGAGT<br>GCAAACATGAACAAGGCTTTGCAAGAAGAATTAACAGAACTAAAAGATG<br>AAATTTCTCTCTATGAATCTGCTGCAAAACTAGGAATACATCCAAGTGAC<br>TCAGAAGGAGAATTAAATATAGAACTCACTGAATCGTATGTGGATTTGGG<br>TATTAAAAAGGTCAACTGGAAAAAATCCAAAGTTACCAGCATTGTACAA<br>GAAGAAGACCCAAATGAAGAGCTTTCAAAAGATGAGTTCATTCTGAAGT<br>TAAAGGCAGAAGTACAGCGTTTGCTGGGTAGCAACTCAATGAAGCGTCA<br>TCTGGTGTCTCAGTTACAAAATGACCTCAAAGACTGTCATAAGAAAATTG<br>AAGATCTCCACCAAGTGAAGAAGGATGAAAAAAGCATTGAGGTTGAGAC<br>TAAAACAGATACCTCAGAAAAACCAAAGAATCAATTATGGCCTGAGTCTT<br>CTACTTCTGATGTTGTCAGAGATGATATTCTGCTGCTTAAAAATGAAATTC<br>AAGTTTTACAACAACAAAATCAGGAACTTAAAGAAACTGAAGGAAAACT<br>GAGAATACAAATCAAGACTTATGTAATCAAATGAGACAAATGGTACAA<br>GATTTTGACCATGACAAACAAGAAGCTGTGGATAGGTGTGAAAGGACTT<br>ATCAGCAGCACCATGAAGCCATGAAAACTCAAATACGTGAAAGCCTATT<br>AGCAAAGCATGCTTTGGAGAAGCAGCAGCTCTTTGAGGCTTATGAGAGA<br>ACTCATTTGCAACTGAGGTCTGAGTTGGATAAGTTGAATAAGGAGGTGAC<br>TGCTGTGCAGGAATGTTACCTAGAAGTGTGCAGAGAGAAGGATAATCTA<br>GAATTGACTCTCAGGAAGACCACTGAAAAGGAGCAACAGACTCAGGAGA<br>AGATTTTTTACCCAGAAACTACAGATATCTATGATCGAAAGAACATGCCA<br>AGATGTATCTACTGTATCCATGCACTCAGTTTGTACCTGTTCAAGCTAGGC<br>CTGGCCCCTCAGATTCAAGACCTATATGGAAAGGTTGACTTCACAGAAGA<br>AGAAATCAACAACATGAAGACTGAGTTGGAGAAGTATGGCATCCAGATG<br>CCTGCCTTTAGCAAGATTGGGGCATCTTGGCTAATGAACTGTCAGTGGA<br>TGAAGCCGCATTACATGCTGCTGTTATTGCTATTAATGAAGCTATTGACC<br>GTAGAATTCCAGCCGACACATTTGCAGCTTTGAAAAATCCGAATGCCATG<br>CTTGTAAATCTTGAAGAGCCCTTGGCATCCACTTACCAGGATATACTTTAC<br>CAGGCTAAGCAGGACAAAATGACAAATGCTAAAAACAGGACAGAAAACT<br>CAGAGAGAGAAAGAGATGTTTATGAGGAGCTGCTCACGCAAGCTGAAAT<br>TCAAGGCAATATAAACAAAGTCAATACATTTTCTGCATTAGCAAATATCG<br>ACCTGGCTTTAGAACAAGGAGATGCACTGGCCTTGTTCAGGGCTCTGCAG<br>TCACCAGCCCTGGGGCTTCGAGGACTGCAGCAACAGAATAGCGACTGGT<br>ACTTGAAGCAGCTCCTGAGTGATAAACAGCAGAAGAGACAGAGTGGTCA<br>GACTGACCCCCTGCAGAAGGAGGAGCTGCAGTCTGGAGTGGATGCTGCA<br>AACAGTGCTGCCCAGCAATATCAGAGAAGATTGGCAGCAGTAGCACTGA<br>TTAATGCTGCAATCCAGAAGGGTGTTGCTGAGAAGACTGTTTTGGAACTG<br>ATGAATCCCGAAGCCCAGCTGCCCCAGGTGTATCCATTTGCCGCCGATCT<br>CTATCAGAAGGAGCTGGCTACCCTGCAGCGACAAAGTCCTGAACATAATC<br>TCACCCACCCAGAGCTCTCTGTCGCAGTGGAGATGTTGTCATCGGTGGCC<br>CTGATCAACAGGGCATTGGAATCAGGAGATGTGAATACAGTGTGGAAGC<br>AATTGAGCAGTTCAGTTACTGGTCTTACCAATATTGAGGAAGAAAACTGT<br>CAGAGGTATCTCGATGAGTTGATGAAACTGAAGGCTCAGGCACATGCAG<br>AGAATAATGAATTCATTACATGGAATGATATCCAAGCTTGCGTGGACCAT<br>GTGAACCTGGTGGTGCAAGAGGAACATGAGAGGATTTTAGCCATTGGTTT<br>AATTAATGAAGCCCTGGATGAAGGTGATGCCCAAAAGACTCTGCAGGCC<br>CTACAGATTCCTGCAGCTAAACTTGAGGGAGTCCTTGCAGAAGTGGCCCA<br>GCATTACCAAGACACGCTGATTAGCGAAGAGAGAGAAAGCCCAGGAA<br>ATCCAGGATGAGTCAGCTGTGTTATGGTTGGATGAAATTCAAGGTGGAAT<br>CTGGCAGTCCAACAAAGACACCCAAGAAGCACAGAAGTTTGCCTTAGGA<br>ATCTTTGCCATTAATGAGGCAGTAGAAAGTGGTGATGTTGGCAAAACACT<br>GAGTGCCCTTCGCTCCCCTGATGTTGGCTTGTATGGAGTCATCCCTGAGTG<br>TGGTGAAACTTACCACAGTGATCTTGCTGAAGCCAAGAAGAAAAAACTG<br>GCAGTAGGAGATAATAACAGCAAGTGGGTGAAGCACTGGGTAAAAGGTG<br>GATATTATTATTACCACAATCTGGAGACCCAGGAAGGAGGATGGGATGA<br>ACCTCCAAATTTTGTGCAAAATTCTATGCAGCTTTCTCGGGAGGAGATCC<br>AGAGTTCTATCTCTGGGGTGACTGCCGCATATAACCGAGAACAGCTGTGG<br>CTGGCCAATGAAGGCCTGATCACCAGGCTGCAGGCTCGCTGCCGTGGATA<br>CTTAGTTCGACAGGAATTCCGATCCAGGATGAATTTCCTGAAGAAACAAA | |

TABLE B-continued

| Gene Fusion | Chimera Sequence | SEQ ID NO. |
|---|---|---|
| | TCCCTGCCATCACCTGCATTCAGTCACAGTGGAGAGGATACAAGCAGAAG<br>AAGGCATATCAAGATCGGTTAGCTTACCTGCGCTCCCACAAAGATGAAGT<br>TGTAAAGATTCAGTCCCTGGCAAGGATGCACCAAGCTCGAAAGCGCTATC<br>GAGATCGCCTGCAGTACTTCCGGGACCATATAAATGACATTATCAAATC<br>CAGGCTTTTATTCGGGCAAACAAAGCTCGGGATGACTACAAGCACTCCAT<br>CAATGCTGAGGATCCTCCTATGGTTGTGGTCCGAAAATTTGTCCACCTGCT<br>GGACCAAAGTGACCAGGATTTTCAGGAGGAGCTTGACCTTATGAAGATG<br>CGGGAAGAGGTTATCACCCTCATTCGTTCTAACCAGCAGCTGGAGAATGA<br>CCTCAATCTCATGGATATCAAAATTGGACTGCTAGTGAAAAATAAGATTA<br>CGTTGCAGGATGTGGTTTCCCACAGTAAAAAACTTACCAAAAAAAATAA<br>GGAACAGTTGTCTGATATGATGATGATAAATAAACAGAAGGGAGGTCTC<br>AAGGCTTTGAGCAAGGAGAAGAGAGAGAAGTTGGAAGCTTACCAGCACC<br>TGTTTTATTTATTGCAAACCAATCCCACCTATCTGGCCAAGCTCATTTTTC<br>AGATGCCCCAGAACAAGTCCACCAAGTTCATGGACTCTGTAATCTTCACA<br>CTCTACAACTACGCGTCCAACCAGCGAGAGGAGTACCTGCTCCTGCGGCT<br>CTTTAAGACAGCACTCCAAGAGGAAATCAAGTCGAAGGTAGATCAGATT<br>CAAGAGATTGTGACAGGAAATCCTACGGTTATTAAATGGTTGTAAGTTT<br>CAACCGTGGTGCCCGTGGCCAGAATGCCCTGAGACAGATCTTGGCCCCAG<br>TCGTGAAGGAAATTATGGATGACAAATCTCTCAACATCAAAACTGACCCT<br>GTGGATATTTACAAATCTTGGGTTAATCAGATGGAGTCTCAGACAGGAGA<br>GGCAAGCAAACTGCCCTATGATGTGACCCCTGAGCAGGCGCTAGCTCATG<br>AAGAAGTGAAGACACGGCTAGACAGCTCCATCAGGAACATGCGGGCTGT<br>GACAGACAAGTTTCTCTCAGCCATTGTCAGCTCTGTGGACAAAATCCCTT<br>ATGGGATGCGCTTCATTGCCAAAGTGCTGAAGGACTCGTTGCATGAGAAG<br>TTCCCTGATGCTGGTGAGGATGAGCTGCTGAAGATTATTGGTAACTTGCT<br>TTATTATCGATACATGAATCCAGCCATTGTTGCTCCTGATGCCTTTGACAT<br>CATTGACCTGTCAGCAGGAGGCCAGCTTACCACAGACCAACGCCGAAAT<br>CTGGGCTCCATTGCAAAAATGCTTCAGCATGCTGCTTCCAATAAGATGTT<br>TCTGGGAGATAATGCCCACTTAAGCATCATTAATGAATATCTTTCCCAGT<br>CCTACCAGAAAATTCAGACGGTTTTTCCAAACTGCTTGTGATGTCCCAGAG<br>CTTCAGGATAAATTTAATGTGGATGAGTACTCTGATTTAGTAACCCTCAC<br>CAAACCAGTAATCTACATTTCCATTGGTGAAATCATCAACACCCACACTC<br>TCCTGTTGGATCACCAGGATGCCATTGCTCCGGAGCACAATGATCCAATC<br>CACGAACTGCTGGACGACCTCGGCGAGGTGCCCACCATCGAGTCCCTGAT<br>AGGGGAAAGCTCTGGCAATTTAAATGACCCAAATAAGGAGGCACTGGCT<br>AAGACGGAAGTGTCTCTCACCCTGACCAACAAGTTCGACGTGCCTGGAGA<br>TGAGAATGCAGAAATGGATGCTGAACCATCTTACTGAATACAAAACGTT<br>TAATTGTGGATGTCATCCGGTTCCAGCCAGGAGAGACCTTGACTGAAATC<br>CTAGAAACACCAGCCACCAGTGAACAGGAAGCAGAACATCAGAGAGCCA<br>TGCAGAGACGTGCTATCCGTGATGCCAAAACACCTGACAAGATGAAAAA<br>GTCAAAATCTGTAAAGGAAGACAGCAACCTCACTCTTCAAGAGAAGAAA<br>GAGAAGATCCAGACAGGTTTAAAGAAGCTAACAGAGCTTGGAACCGTGG<br>ACCCAAAGAACAAATACCAGGAACTGATCAACGACATTGCCAGGGATAT<br>TCGGAATCAGCGGAGGTACCGACAGAGGAGAAAGGCCGAACTAGTGAAA<br>CTGCAACAGACATACGCTGCTCTGAACTCTAAGGCCACCTTTTATGGGGA<br>GCAGGTGGATTACTATAAAAGCTATATCAAAACCTGCTTGGATAACTTAG<br>CCAGCAAGGGCAAATCTCCAAAAAGCCTAGGGAAATGAAAGGAAGA<br>AAAGCAAAAAGATTTCTCTGAAATATACAGCAGCAAGACTACATGAAAA<br>AGGAGTTCTTCTGGAAATTGAGGACCTGCAAGTGAATCAGTTTAAAAATG<br>TTATATTTGAAATCAGTCCAACAGAAGAAGTTGGAGACTTCGAAGTGAAA<br>GCCAAATTCATGGGAGTTCAAATGGAGACTTTTATGTTACATTATCAGGA<br>CCTGCTGCAGCTACAGTATGAAGGAGTTGCAGTCATGAAATTATTTGATA<br>GAGCTAAAGTAAATGTCAACCTCCTGATCTTCCTTCTCAACAAAAAGTTC<br>TACGGGAAGTAA | |
| SLC19A2<br>-><br>NAA50 | ATGGATGTGCCCGGCCCGGTGTCTCGGCGGGCGGCGGCGGCGGCCA<br>CTGTGCTCCTGCGGACCGCTCGGGTCCGTCGCGAATGCTGGTTCTTGCCG<br>ACCGCGCTGCTCTGCGCCTACGGCTTCTTCGCCAGCCTCAGGCCGTCCGA<br>GCCCTTCCTGACCCCGTACCTGCTGGGGCCGGACAAGAACCTGACCGAGA<br>GGGAGTAGCCGGATCGAGCTGGGAGATGTGACACCCACAATATTAAAC<br>AGTTGAAAAGATTGAATCAGGTCATCTTTCCAGTCAGCTACAATGACAAG<br>TTCTACAAGGATGTGCTGGAGGTTGGCGAGCTAGCAAAACTTGCCTATTT<br>CAATGATATTGCTGTAGGTGCAGTATGCTGTAGGGTGGATCATTCACAGA<br>ATCAGAAGAGACTTTACATCATGACACTAGGATGTCTGGCACCTTACCGA<br>AGGCTAGGAATAGGAACTAAAATGTTAAATCATGTCTTAAACATCTGTGA<br>AAAAAGATGGTACTTTGACAACATTTATCTGCATGTCCAGATCAGCAATG<br>AGTCGGCAATTGACTTCTACAGGAAGTTTGGCTTTGAGATTATTGAGACA<br>AAGAAGAACTACTATAAGAGGATAGAGCCCGCAGATGCTCATGTGCTGC<br>AGAAAAACCTCAAAGTTCCTTCTGGTCAGAATGCAGATGTGCAAAAGAC<br>AGACAACTGA | SEQ ID<br>NO: 61 |
| SFXN1-><br>CAMK4 | ACAGGCGCGCGCGAGGACGCGCTCCGGGGACGCGCGAGGACGCCGTGGC<br>GGGGAGAAGCGTTTCCGGTGGCGGCGGAGGCTGCACTGAGCGGGACCTGC<br>GAGCAGCGCGGGCGGCAGCCCGGGGAAGCGTATCTACATGAAAATGGG<br>ATTGTCCATCGTGATCTCAAACCAGAGAATCTTCTTTATGCAACTCCAGCC<br>CCAGATGCACCACTCAAAATCGCTGATTTTGGACTCTCTAAAATTGTGGA<br>ACATCAAGTGCTCATGAAGACAGTATGTGGAACCCCAGGGTACTGCGCA | SEQ ID<br>NO: 62 |

TABLE B-continued

| Gene Fusion | Chimera Sequence | SEQ ID NO. |
|---|---|---|
| | CCTGAAATTCTTAGAGGTTGTGCCTATGGACCTGAGGTGGACATGTGGTC<br>TGTAGGAATAATCACCTACATCTTACTTTGTGGATTTGAACCATTCTATGA<br>TGAAAGAGGCGATCAGTTCATGTTCAGGAGAATTCTGAATTGTGAATATT<br>ACTTTATCTCCCCCTGGTGGGATGAAGTATCTCTAAATGCCAAGGACTTG<br>GTCAGAAAATTAATTGTTTTGGATCCAAAGAAACGGCTGACTACATTTCA<br>AGCTCTCCAGCATCCGTGGGTCACAGGTAAAGCAGCCAATTTTGTACACA<br>TGGATACCGCTCAAAAGAAGCTCCAAGAATTCAATGCCCGGCGTAAGCTT<br>AAGGCAGCGGTGAAGGCTGTGGTGGCCTCTTCGCGCCTGGGAAGTGCCA<br>GCAGCAGCCATGGCAGCATCCAGGAGAGCCACAAGGCTAGCCGAGACCC<br>TTCTCCAATCCAAGATGGCAACGAGGACATGAAAGCTATTCCAGAAGGA<br>GAGAAAATTCAAGGCGATGGGGCCCAAGCCGCAGTTAAGGGGGCACAGG<br>CTGAGCTGATGAAGGTGCAAGCCTTAGAGAAAGTTAAAGGTGCAGATAT<br>AAATGCTGAAGAGGCCCCCAAAATGGTGCCCAAGGCAGTGGAGGATGGG<br>ATAAAGGTGGCTGACCTGGAACTAGAGGAGGGCCTAGCAGAGGAGAAGC<br>TGAAGACTGTGGAGGAGGCAGCAGCTCCCAGAGAAGGGCAAGGAAGCTC<br>TGCTGTGGGTTTTGAAGTTCCACAGCAAGATGTGATCCTGCCAGAGTACT<br>AAACAGCTTCCTTCAGATCTGGAAGCCAAACACCGGCATTTTATGTACTT<br>TGTCCTTCAGCAAGAAAGGTGTGGAAGCATGATATGTACTATAGTGATTC<br>TGTTTTTGAGGTGCAAAAAACATACATATATACCAGTTGGTAATTCTAAC<br>TTCAATGCATGTGACTGCTTTATGAAAATAATAGTGTCTTCTATGGCATGT<br>AATGGATACCTAATACCGATGAGTTAAATCTTGCAAGTTAACACAACGTA<br>ACACTTAAAAGCATACATTTTCAGCAACCAGTGGCACATATTTGAAGTGA<br>ATAGTAGCAAATTGTTTTTGCTTTGAAAATCTAGCCATCCTACATCCTTTG<br>GATTCTTCACAAGGCAGTAATTCCTTTGAACTACTGCTTAGCTAATACTA<br>GGTAGTGCTAAAAGACATGTTCCCATAACTTTTACAACATTTTACTTTTTA<br>TCATTGATGTGTTCAAACTGTTTACAAGGAGATGCTTATAGATGATAGTT<br>GTACATATGTGCAAAAAAAAATCCACTTGCAATGGTAAGAAATTGAAGT<br>ATCCTTAAAGGCCATGAAGCCATATGTCCCTAAA | |
| CREB1-><br>TMEM131 | ATGACCATGGAATCTGGAGCCGAGAACCAGCAGAGTGGAGATGCAGCTG<br>TAACAGAAGCTGAAAACCAACAAATGACAGTTCAAGCCCAGCCACAGAT<br>TGCCACATTAGCCCAGGTATCTATGCCAGCAGCTCATGCAACATCATCTG<br>CTCCCACCGTAACTCTAGTACAGCTGCCCAATGGGCAGACAGTTCAAGTC<br>ATGGAGTCATTCAGGCGGCCCAGCCATCAGTTATTCAGTCTCCACAAGT<br>CCAAACAGTTCAGATTTCAACTATTGCAGAAAGTGAAGATTCACAGGAGT<br>CAGTGGATAGTGTAACTGATTCCCAAAAGCGAAGGGAAATTCTTTCAAGG<br>AGGCCTTCCTACAGGAAAATTTTGAATGACTTATCTTCTGATGCACCAGG<br>AGTGCCAAGGATTGAAGAAGAGAAGTCTGAAGAGGAGACTTCAGCACCT<br>GCCATCACCACTGTAACGGTGCCAACTCCAATTTACCAAACTAGCAGTGG<br>ACAGTATACATTCGTTCAGTCAGAGAGCATAATAGAAGTACTGCGTTTTG<br>ATGATGGAGGGCTACTACAGACCGAGACAACACTTGGACTCAGTTCATAT<br>CAGCAGAAAGTATATCTCTCTACCGGGGGAATTGCAGGCCCATACGATT<br>TGAGCCACCAATGCTGGATTTCCATGAACAACCAGTTGGAATGCCAAAAA<br>TGGAAAAGTCTACTTACATAATCCTAGTTCTGAAGAAACGATTACTTTA<br>GTATCAATATCTGCTACAACATCACATTTTCATGCATCATTTTTTCAAAAT<br>AGGAAAATTCTTCCAGGAGGAAATACATCATTTGATGTAGTTTTTCTTGC<br>AAGAGTAGTAGGAAATGTAGAAAATACTTTATTTATTAATACATCTAATC<br>ATGGGGTATTTACTTACCAGGTATTTGGTGTTGGAGTTCCAAATCCATATC<br>GATTGAGGCCGTTCCTTGGGGCCAGAGTCCCTGTGAATAGCAGTTTCTCA<br>CCTATAATAAACATCCACAATCCTCACAGTGAGCCTTTACAGGTTGTAGA<br>AATGTACTCTAGTGGAGGAGACCTTCACCTAGAACTCCCAACGGGTCAAC<br>AAGGAGGTACCAGAAAACTGTGGGAAATTCCTCCTTATGAAACCAAGGG<br>AGTGATGAGAGCCAGTTTTTCATAGAGAAGCAGATAATCACACAGCCT<br>TCATAAGAATAAAGACTAATGCTTCAGACAGCACAGAGTTTATCATTCTT<br>CCTGTTGAGGTTGAAGTTACAACAGCTCCTGGAATTTATTCCTCAACTGA<br>AATGTTAGATTTTGGTACACTAAGAACACAAGATCTACCAAAAGTTTTAA<br>ACCTTCATTTATTAAATTCAGGAACAAAAGATGTACCAATAACAAGTGTT<br>CGACCTACACCACAAAATGATGCTATAACGGTACACTTTAAACCAATTAC<br>ATTAAAAGCATCAGAAAGTAAATACACCAAGGTTGCAAGCATTAGTTTTG<br>ATGCATCGAAGGCAAAAAAGCCATCTCAGTTTTCTGGGAAAATAACAGTT<br>AAAGCAAAGGAAAAGAGTTATTCTAAACTTGAAATACCATATCAAGCAG<br>AAGTTTTAGATGGTTATTTGGGATTTGATCATGCTGCAACATTATTTCACA<br>TCCGAGACAGCCCTGCTGATCCTGTGGAAAGGCCAATTTACCTTACTAAC<br>ACTTTCAGTTTTGCGATCCTCATTCACGATGTGTTGCTACCAGAAGAAGCC<br>AAAACAATGTTTAAAGTTCACAACTTCAGCAAACCAGTCTTAATTCTTCC<br>TAATGAATCAGGATACATTTTTACCCTGCTTTTTATGCCTTCCACATCATC<br>CATGCACATTGATAACAACATTTTACTTATTACCAATGCTTCTAAATTTCA<br>TTTACCCGTGCGGGTATACACAGGCTTTTTAGATTACTTTGTATTGCCCCC<br>CAAAATAGAGGAACGTTTCATAGATTTTGGAGTACTGAGTGCTACAGAAG<br>CAAGTAATATTTTATTTGCAATTATAAACAGCAATCCAATTGAGTTGGCT<br>ATAAAAAGTTGGCATATCATAGGAGACGGTTTATCAATAGAACTTGTAGC<br>TGTGGAAAGAGGCAATAGAACTACAATAATTTCAAGCCTGCCAGATTTG<br>AAAAATCCTCTTTATCAGATCAATCATCGGTAACATTAGCTTCAGGCTATT<br>TTGCAGTCTTCAGAGTCAAACTTACTGCAAAAAAATTAGAGGGGATTCAT<br>GATGGAGCCATCCAGATCACAACAGACTATGAGATCCTGACAATCCCTGT<br>GAAGGCTGTGATTGCAGTAGGCTCACTGACCTGCTTCCCTAAGCACGTGG<br>TTCTTCCACCTTCCTTTCCAGGGAAAATAGTTCATCAAAGTTTAAATATTA | SEQ ID NO: 63 |

TABLE B-continued

| Gene Fusion | Chimera Sequence | SEQ ID NO. |
|---|---|---|
| | TGAATTCCTTCTCACAGAAGGTAAAAATACAGCAAATACGATCTTTGTCA<br>GAAGATGTGCGATTTTACTATAAACGATTACGGGGCAATAAGGAAGACTT<br>GGAGCCAGGAAAAAAATCAAAGATTGCAAACATTTTATTTTGATCCTGGAC<br>TACAGTGTGGGGATCATTGCTATGTTGGCTTGCCTTTTCTATCCAAATCTG<br>AACCCAAAGTGCAGCCTGGTGTAGCCATGCAGGAAGATATGTGGGATGC<br>TGACTGGGATTTGCATCAAAGCCTGTTCAAGGGATGGACAGGAATAAAG<br>GAAAATTCAGGTCATAGATTGAGTGCTATATTTGAAGTAAATACAGACCT<br>TCAAAAAAATATAATATCAAAAATCACTGCTGAGCTCTCCTGGCCTTCCA<br>TACTTAGCTCACCCCGGCACTTGAAATTTCCACTTACTAATACAAACTGCT<br>CCTCAGAAGAAGAGATTACTTTAGAAAATCCTGCAGATGTTCCTGTCTAT<br>GTTCAGTTTATTCCTCTGGCTTTATATTCCAACCCTTCAGTGTTTGTAGAT<br>AAGTTAGTATCAAGGTTTAACTTGAGTAAGGTGGCAAAGATAGATTTGAG<br>AACACTAGAATTTCAAGTCTTCAGAAACAGTGCTCATCCACTGCAGAGTT<br>CAACAGGATTTATGGAGGGCCTCTCTCGACATTTAATTTTAAACCTAATTT<br>TAAAACCTGGAGAAAAGAAATCTGTCAAAGTAAAGTTTACTCCAGTTCAC<br>AACAGAACTGTTTCTTCACTTATCATAGTCAGAAATAACCTGACTGTGAT<br>GGATGCTGTGATGGTCCAAGGACAAGGAACAACTGAGAACTTGAGGGTG<br>GCAGGCAAGCTTCCAGGTCCAGGAAGCTCCTTACGCTTTAAAATCACGGA<br>AGCATTGTTAAAAGATTGTACAGATAGTTTAAAACTAAGAGAACCAAATT<br>TCACATTGAAAAGAACATTTAAGGTAGAGAATACAGGACAACTTCAAAT<br>TCACATAGAAACCATTGAAATCAGTGGATACTCATGTGAAGGATATGGCT<br>TTAAAGTTGTTAATTGTCAAGAGTTTACTCTAAGTGCCAATGCTTCTAGAG<br>ATATAATCATATTGTTTACTCCTGATTTTACAGCTTCTAGAGTTATTCGGG<br>AACTGAAGTTTATAACAACCAGTGGCTCTGAGTTTGTATTTATATTGAAT<br>GCATCCCTTCCTTACCATATGTTAGCAACCTGTGCAGAAGCCCTACCCAG<br>ACCTAACTGGGAACTGGCTCTGTATATCATCATCTCAGGAATAATGAGTG<br>CACTGTTTCTTTTGGTCATTGGAACAGCCTATTTGGAAGCTCAAGGAATAT<br>GGGAGCCATTTCGAAGGCGGCTATCCTTTGAGGCCTCGAACCCGCCCTTC<br>GATGTGGGAAGGCCATTTGATCTCAGGAGAATCGTTGGTATTTCATCTGA<br>AGGAAACTTGAACACACTCAGCTGTGACCCCGGTCACAGTAGGGGGTTCT<br>GTGGAGCAGGCGGTTCATCATCCCGACCCAGTGCCGGGAGTCATAAGCA<br>GTGTGGCCCATCGGTCCACCCACACAGCAGTCACAGCAATAGAAACTCA<br>GCTGACGTGGAAAACGTCAGAGCCAAAAACAGTTCAAGTACCTCTAGTA<br>GGACTTCTGCTCAAGCAGCTTCTTCACAGTCTGCTAACAAAACAAGCCCC<br>CTTGTCTTAGATTCGAACACAGTGACTCAAGGTCATACAGCGGGCAGAAA<br>GTCCAAAGGGGCAAAGCAGAGCCAGCACGGCAGCCAGCACCATGCCCAC<br>AGCCCGCTGGAGCAGCACCCTCAGCCTCCTCTGCCACCGCCAGTGCCTCA<br>GCCCCAGGAGCCGCAGCCTGAAAGGCTGTCTCCCGCCCCCTCGCACACC<br>CTTCCCACCCAGAACGTGCCAGCAGCGCGAGGCACAGTTCCGAGGACTC<br>GGACATCACCAGTCTCATAGAAGCCATGGACAAAGACTTCGACCACCAT<br>GACTCCCCAGCCCTAGAAGTGTTTACAGAGCAGCCTCCATCGCCATTGCC<br>AAAAAGCAAAGGGAAAGGAAAACCTCTTCAGCGCAAGGTGAAACCACCT<br>AAGAAGCAAGAGGAAAAGGAGAAGAAGGGAAAGGGAAAGCCACAGGA<br>AGATGAGCTGAAGGACTCTTTGGCTGATGATGATAGCTCCTCCACCACCA<br>CAGAGACCTCCAACCCTGACACAGAACCGCTCCTCAAGGAGGATACAGA<br>AAAGCAAAAGGGAAACAAGCCATGCCTGAAAAACATGAAAGTGAAAT<br>GTCTCAAGTGAAGCAAAAAAGCAAAAAACTCTTAAATATTAAGAAAGAA<br>ATCCCAACAGATGTGAAACCCAGTTCATTAGAACTACCATATACTCCCCC<br>TTTGGAAAGTAAGCAACGTAGAAATCTCCCAAGCAAGATTCCTCTTCCAA<br>CTGCAATGACAAGTGGATCCAAATCACGAAATGCCCAGAAAACAAAAGG<br>TACAAGTAAGTTAGTGGATAACAGACCACCTGCCCTAGCAAAATTCCTCC<br>CGAATAGTCAAGAATTAGGCAACACCAGTAGCTCAGAGGGTGAAAAAGA<br>CTCTCCTCCACCGGAGTGGGATTCCGTTCCAGTTCACAAACCTGGCAGCT<br>CTACTGATAGTCTTTATAAACTTTCTCTGCAAACCCTCAACGCAGACATTT<br>TCTTAAAACAACGCCAGACCTCACCGACACCTGCTTCCCCGTCTCCCCCA<br>GCTGCCCCCTGCCCCTTTGTGGCCCGGGGCAGCTACAGCAGCATCGTCAA<br>CAGCAGCTCCAGCAGTGACCCTAAAATAAAACAGCCAAATGGAAGCAAA<br>CACAAGTTGACAAAGGCAGCCTCGCTCCCGGCAAGAACGGCAACCCCA<br>CTTTTGCTGCAGTCACGGCTGGCTACGACAAGAGCCAGGTGGGAATGGC<br>TTTGCTAAAGTTTCTTCAAACAAAACAGGTTTCTCCAGCAGCCTTGGCATT<br>TCACACGCTCCTGTTGACAGCGATGGCTCAGACAGCTCGGGTTTGTGGAG<br>TCCCGTCAGCAACCCAAGCAGCCCTGACTTCACTCCCCTCAATTCGTTCTC<br>CGCCTTTGGAAACTCTTTTAATCTAACTGGTGAAGTTTTCAGCAAACTCGG<br>ATTATCTCGATCGTGCAATCAGGCCTCACAGAGGAGCTGGAACGAGTTTA<br>ATAGTGGCCCTTCATACCTTTGGGAGTCGCCAGCGACAGATCCCAGTCCT<br>TCCTGGCCAGCCAGTTCCGCTCCCCGACCCACACAGCCACATCGGTCCT<br>CGGTAACACCAGCGGCCTGTGGTCCACCACTCCATTCAGCAGCTCCATTT<br>GGTCCAGCAACCTTAGCAGCGCCCTTCCCTTCACCACTCCAGCAAACACG<br>CTGGCAAGCATCGGCCTCATGGGCACAGAAAACTCCCCTGCTCCTCACGC<br>TCCCTCCACCTCCAGTCCAGCTGACGACTTGGGACAGACCTACAACCCGT<br>GGCGGATATGGAGCCCACGATTGGAAGAAGAAGCTCGGACCCTTGGTC<br>TAATTCGCACTTTCCTCACAGAGAATTAA | |
| ESR1-><br>C6orf211 | ATGACCATGACCCTCCACACCAAAGCATCTGGGATGGCCCTACTGCATCA<br>GATCCAAGGGAACGAGCTGGAGCCCCTGAACCGTCCGCAGCTCAAGATC<br>CCCCTGGAGCGGCCCCTGGGCGAGGTGTACCTGGACAGCAGCAAGCCCG<br>CCGTGTACAACTACCCCGAGGGCGCCGCCTACGAGTTCAACGCCGCGGCC | SEQ ID NO: 64 |

TABLE B-continued

| Gene Fusion | Chimera Sequence | SEQ ID NO. |
|---|---|---|
| | GCCGCCAACGCGCAGGTCTACGGTCAGACCGGCCTCCCCTACGGCCCCGG<br>GTCTGAGGCTGCGGCGTTCGGCTCCAACGGCCTGGGGGGTTTCCCCCCAC<br>TCAACAGCGTGTCTCCGAGCCCGCTGATGCTACTGCACCCGCCGCCGCAG<br>CTGTCGCCTTTCCTGCAGCCCCACGGCCAGCAGGTGCCCTACTACCTGGA<br>GAACGAGCCCAGCGGCTACACGGTGCGCGAGGCCGGCCCCGCCGGCATTC<br>TACAGTCCACCAATCGATTACTTTGATGTATTTAAAGAATCAAAAGAGCA<br>AAATTTCTATGGGTCACAGGAATCCATCATTGCTTTATGTACTCACCTGCA<br>ACAATTGATAAGAACTATTGAAGACCTAGATGAAAATCAGCTGAAAGAT<br>GAGTTTTTTAAACTTCTGCAGATTTCACTGTGGGGAAATAAGTGTGATCT<br>GTCTCTCTCAGGTGGAGAAAGTAGTTCTCAGAATACCAATGTACTAAATT<br>CATTGGAAGACCTAAAACCTTTCATTTTATTGAATGATATGGAACATCTTT<br>GGTCATTGCTTAGCAATTGCAAGAAAACAAGAGAAAAAGCTTCTGCTACT<br>AGAGTGTATATTGTTCTCGATAATTCTGGATTTGAGCTTGTTACAGATTTA<br>ATATTAGCCGACTTCTTGTTGTCCTCTGAACTGGCTACTGAGGTTCATTTT<br>TATGGAAAAACAATTCCATGGTTTGTTTCTGATACTACTATACATGATTTT<br>AATTGGTTAATTGAACAGGTAAAACACAGTAATCATAAGTGGATGTCCAA<br>GTGTGGGGCTGACTGGGAAGAGTATATTAAAATGGGTAAATGGGTTTACC<br>ACAATCATATATTTTGGACTCTGCCTCATGAGTACTGTGCAATGCCTCAG<br>GTTGCACCTGACTTATATGCTGAACTACAGAAGGCACATTTAATTTTATTC<br>AAGGGTGATTTGAATTACAGGAAGTTGACAGGTGACAGAAAATGGGAGT<br>TTTCTGTTCCATTTCATCAGGCTCTGAATGGCTTCCATCCTGCACCACTCT<br>GTACCATAAGAACATTAAAAGCTGAAATTCAGGTTGGTCTGCAGCCTGGG<br>CAAGGGGAACAGCTCCTGGCCTCTGAGCCCAGCTGGTGGACCACTGGAA<br>AATATGGAATATTTCAGTACGATGGTCCCCTTTGA | |
| UTP23 -><br>RAD21 | ATGAAGATCACAAGGCAGAAACATGCCAAGAAGCATCTTGGCTTCTTCCG<br>CAACAACTTCGGAGTCCGCGAGCCGTACCAGATCCTGCTGGACGGCACCT<br>TCTGTCAGGCGGCGCTGCGGGGCCGCATCCAGCTGCGGGAGCAGCTGCCC<br>CGCTACCTCATGGGGGAGACGCAGCTGTGCACCACAAGATGTTCTACGCA<br>CATTTTGTTCTCAGTAAAAGAGGGCCTCTGGCCAAAATTTGGCTAGCGGC<br>CCATTGGGATAAGAAGCTAACCAAAGCCCATGTGTTCGAGTGTAATTTAG<br>AGAGCAGCGTGGAGAGTATCATCTCACCAAAGGTGAAAATGGCATTACG<br>GACATCAGGACATCTCTTACTGGGAGTAGTTCGAATCTATCACAGGAAAG<br>CCAAATACCTTCTTGCAGACTGTAATGAAGCATTCATTAAGATAAAGATG<br>GCTTTTCGGCCAGGTGTGGTTGACCTGCCTGAGGAAAATCGGGAAGCAGC<br>TTATAATGCCATTACTTTACCTGAAGAATTTCATGACTTTGATCAGCCACT<br>GCCTGACTTAGATGACATCGATGTGGCCCAGCAGTTCAGCTTGAATCAGA<br>GTAGAGTGGAAGAGATAACCATGAGAGAAGAAGTTGGGAACATCAGTAT<br>TTTACAAGAAAATGATTTTGGTGATTTTGGAATGGATGATCGTGAAGATAA<br>TGAGAGAAGGCAGTGCTTTTGAGGATGACGACATGTTAGTAAGCACTACT<br>ACTTCTAACCTCCTATTAGAGTCTGAACAGAGCACCAGCAATCTGAATGA<br>GAAAATTAACCATTTAGAATATGAAGATCAATATAAGGATGATAATTTTG<br>GAGAAGGAAATGATGGTGGAATATTAGATGACAAACTTATTAGTAATAA<br>TGATGGCGGTATCTTTGATGATCCCCTGCCCTCTCTGAGGCAGGGGTGA<br>TGTTGCCAGAGCAGCCTGCACATGACGATATGGATGAGGATGATAATGTA<br>TCAATGGGTGGGCCTGATAGTCCTGATTCAGTGGATCCCGTTGAACCAAT<br>GCCAACCATGACTGATCAAACAACACTTGTTCCAAATGAGGAAGAAGCA<br>TTTGCATTGGAGCCTATTGATATAACTGTTAAAGAAACAAAAGCCAAGAG<br>GAAGAGGAAGCTAATTGTTGACAGTGTCAAAGAGTTGGATAGCAAGACA<br>ATTAGAGCCCAACTTAGTGATTATTCAGATATTGTTACTACTTTGGATCTG<br>GCACCGCCCACCAAGAAATTGATGATGTGGAAAGAGACAGGAGGAGTAG<br>AAAAACTGTTTTCTTTACCTGCTCAGCCTTTGTGGAATAACAGACTACTGA<br>AGCTCTTTACACGCTGTCTTACACCGCTTGTACCAGAAGACCTTAGAAAA<br>AGGAGGAAAGGAGGAGAGGCAGATAATTTGGATGAATTCCTCAAAGAAT<br>TTGAAAATCCAGAGGTTCCTAGAGAGGACCAGCAACAGCAGCATCAGCA<br>GCGTGATGTTATCGATGAGCCCATTATTGAAGAGCCAAGCCGCCTCCAGG<br>AGTCAGTGATGGAGGCCAGCAGAACAAACATAGATGAGTCAGCTATGCC<br>TCCACCACCACCTCAGGGAGTTAAGCGAAAAGCTGGACAAATTGACCCA<br>GAGCCTGTGATGCCTCCTCAGCAGGTAGAGCAGATGGAAATACCACCTGT<br>AGAGCTTCCCCCAGAAGAACCTCCAAATATCTGTCAGCTAATACCAGAGT<br>TAGAACTTCTGCCAGAAAAAGAGAAGGAGAAAGAGAAGGAAAAAGAAG<br>ATGATGAAGAGGAAGAGGATGAAGATGCATCAGGGGGCGATCAAGATCA<br>GGAAGAAAGAAGATGGAACAAAAGGACTCAGCAGATGCTTCATGGTCTT<br>CAGCGTGCTCTTGCTAAAACTGGAGCTGAATCTATCAGTTTGCTTGAGTT<br>ATGTCGAAATACGAACAGAAAACAAGCTGCCGCAAAGTTCTACAGCTTCT<br>TGGTTCTTAAAAAGCAGCAAGCTATTGAGCTGACACAGGAAGAACCGTA<br>CAGTGACATCATCGCAACACCTGGACCAAGGTTCCATATTATATAA | SEQ ID<br>NO: 65 |
| KLHDC4<br>-><br>LRPAP1 | ATGGGCAAGAAGGGCAAGAAGGAGAAGAAGGGCCGCGGCGCGGAGAAG<br>ACGGCCGCCAAGATGGAGAAGAAGGTGTCTAAGCGCTCGCGGAAGGAGG<br>AGGAAGACCTGGAAGCGCTCATAGCCCATTTCCAGACACTCGATGCCAA<br>GAGGACTCAGACTGTGGAACTTCGTGCCCCCCACCCTCACCAAGGTTAA<br>ATGCCTCCCTCTCGGTTCATCCTGAGAAAGATGAGTTAATCCTTTTTGGAG<br>GTGAATATTTCAACGGCCAAAAACTTTTTTGTATAACGAGCTCTATGTCT<br>ACAATACCAGAAAGGACACCTGGACCAAAGTTGACATCCCCAGTCCACC<br>TCCGAGGCGCTGTGCTCACCAGGCGGTGGTAGTGCCTCAAGGTGGCGGAC<br>AGCTGTGGGTCTTTGGAGGGGAGTTTGCCTCTCCCAACGGAGAGCAGTTC | SEQ ID<br>NO: 66 |

TABLE B-continued

| Gene Fusion | Chimera Sequence | SEQ ID NO. |
|---|---|---|
| | TACCACTACAAGGATCTCTGGGTCCTGCATTTGGCCACCAAGACCTGGGA<br>ACAAGTCAAATCAACAGGCGGTCCTTCGGGTCGGAGTGGACATCGGATG<br>GTGGGCCTGGAAGAGACAATTGATCCTGTTTGGTGGCTTCCATGAAAGTAC<br>ACGGGATTACATCTACTACAACGACGTGTATGCCTTTAATCTGGACACCT<br>TCACATGGAGCAAGCTGTCCCCGTCAGGGACGGGGCCCACACCCAGATC<br>AGGCTGCCAGATGTCCGTCACTCCCCAGGGCGGCATCGTCGTCTATGGGG<br>GCTACTCGAAACAGCTGCATCTTCCTCCCGTGAGGCTGGCCGAGCTCCAC<br>GCTGATCTGAAGATACAGGAGAGGGACGAACTCGCCTGGAAGAAACTAA<br>AGCTTGACGGCTTGGACGAAGATGGGGAGAAGGAAGCGAGACTCATACG<br>CAACCTCAATGTCATCTTGGCCAAGTATGGTCTGGACGGAAAGAAGGAC<br>GCTCGGCAGGTGACCAGCAACTCCCTCAGTGGCACCCAGGAAGACGGGC<br>TGGATGACCCCAGGCTGGAAAAGCTGTGGCACAAGGCGAAGACCTCTGG<br>GAAATTCTCCGGCAAGAACTGGACAAGCTCTGGCGGGAGTTCCTGCATC<br>ACAAAGAGAAAGTTCACGAGTACAACGTCCTGCTGGAGACCCTGAGCAG<br>GACCGAAGAAATCCACGAGAACGTCATTAGCCCCTCGGACCTGAGCGAC<br>ATCAAGGGCAGCGTCCTGCACAGCAGGCACACGGAGCTGAAGGAGAAGC<br>TGCGCAGCATCAACCAGGGCCTGGACCGCCTGCGCAGGGTCAGCCACCA<br>GGGCTACAGCACTGAGGCTGAGTTCGAGGAGCCCAGGGTGATTGACCTG<br>TGGGACCTGGCGCAGTCCGCCAACCTCACGGACAAGGAGCTGGAGGCGT<br>TCCGGGAGGAGCTCAAGCACTTCGAAGCCAAAATCGAGAAGCACAACCA<br>CTACCAGAAGCAGCTGGAGATTGCGCACGAGAAGCTGAGGCACGCAGAG<br>AGCGTGGGCGACGGCGAGCGTGTGAGCCGCAGCCGCGAGAAGCACGCCC<br>TGCTGGAGGGGCGGACCAAGGAGCTGGGCTACACGGTGAAGAAGCATCT<br>GCAGGACCTGTCCGGCAGGATCTCCAGAGCTCGGCACAACGAACTCTGA | |
| LOC729852<br>-><br>GLCCI1 | ACCTGAGACTACCTTTCTGCGATCACAGGATTCCCGGCGGTGACTTGACC<br>CCGGAAGTGGGGTGTGAAGCTCCGGTGCTGGTGCGGCGGGGGACTGCGG<br>GGCCAGCCTCAGGTAGCAGCAGCAGCAGCAGCAGCAGCAGCAGCAGCAG<br>CAGCAGCAGCAGCAGCAGCAGCAATGTTTCACTTCTTCAGAAAGCCT<br>CCGGAATCTAAAAAGCCCTCAGTACCAGAGACAGAAGCAGATGGATTCG<br>TCCTTTTAGGAGATACAACAGATGAGCAAAGAATGACAGCAAGAGGCAA<br>AACTTCGGACATAGAGGCCAACCAACCTTTGGAGCGGACAAGGCAAAAT<br>CTCAGCAAGTTCGGACCTCTAGTACAATAAGGCGAACCTCCTCTTTGGAT<br>ACAATAACAGGACCTTACCTCACAGGACAGTGGCCACGGGATCCTCATGT<br>TCACTACCCTTCATGCATGAAAGACAAAGCTACTCAGACACCTAGCTGTT<br>GGGCAGAAGAGGGTGCAGAAAAGAGGTCACATCAGCGTTCTGCGTCATG<br>GGGGAGTGCTGATCAACTAAAAGAGCAGATCGCCAAACTGAGGCAGCAA<br>CTACAACGCAGTAAACAGAGTAGTCGTCACAGTAAGGAGAAAGATCGCC<br>AGTCACCTCTTCATGGCAACCATATAACAATCAGTCACACTCAGGCTACT<br>GGATCAAGGTCAGTTCCTATGCCACTGTCAAATATATCAGTGCCAAAATC<br>ATCTGTTTCGCGTGTGCCCTGCAATGTAGAAGGAATAAGTCCTGAATTAG<br>AAAAGGTATTCATTAAAGAAAATAATGGGAAGGAAGAAGTATCCAAGCC<br>GTTGGACATACCAGATGGTCGAAGAGCTCCACTTCCTGCTCATTACCGGA<br>GCAGTAGTACTCGCAGCATTGACACTCAGACTCCTTCTGTCCAGGAGCGC<br>AGCAGTAGCTGCAGCAGTCATTCACCCTGTGTCTCCCCTTTTTGTCCCCCG<br>GAATCCCAGGATGGTAGCCCTTGCTAACAGAAGATTTGCTCTATGATCG<br>TGATAAAGACAGTGGGAGTAGCTCACCGTTACCCAAGTATGCTTCATCTC<br>CCAAACCAAACAACAGCTACATGTTCAAACGGGAGCCCCCAGAGGGATG<br>TGAGCGAGTGAAGGTCTTTGAGGAAATGGCGTCTCGTCAGCCTATCTCGG<br>CCCCTCTCTTTTCATGTCCTGACAAAAACAAGGTTAATTTCATCCCAACCG<br>GATCAGCTTTCTGTCCTGTAAAACTTCTAGGCCCCCTCTTACCTGCTTCTG<br>ACCTTATGCTCAAGAACTCCCCTAACTCTGGCCAGAGCTCAGCTTTGGCA<br>ACTCTGACCGTTGAGCAGCTCTCATCCCGGGTTTCCTTTACGTCTCTTTCT<br>GATGACACCAGCACAGCGGGCTCCATGGAGGCCTCTGTCCAGCAGCCATC<br>CCAGCAGCAGCAGCTCCTGCAGGAACTGCAGGGTGAGGACCCACATCTCT<br>GCTCAGAACTATGTGATCATCTAAAAAAGGGGAGCTGGCCTCCACCCTA<br>TGTTCCATGGATTCGGAACAAGATTTCAGACATCTGCATGAGTGACAAAC<br>TTTCTGAACACCACCACCACCAATAATACTTATCAGCATCATAAAGTATC<br>TCTTAAACACTGATCTTGGCAGGGACGGAACTCCTATTCAGCAGTTTTTGT<br>GGAAAGCAGTAATGCTTGCAAAACGTGTGTGTCATTCAGCATTTTAAGTG<br>GAGACTATGCATTTCATAGTATATTTGACAGATTAGTACTGTGTCCTGTGT<br>TTTGTTCCAGATTCTTCAGTATAAATAAGCTCTATATCAAAAAGTTGCCTG<br>TCTAAATAGAAAATGTCTTGCTGTGTTTTGTCCTATGGAAAATACTGTAAT<br>TCAGGATTATGTTTACAATTGATCCAGGTGTTTGTTTCTAACTTCTGTAAT<br>ACATACAATGCAAAAAAAAAAAAAAAATGGCCACAACAGTTGCACA<br>GTGCCCACCCTATGGCCTAGCTTCAGGTACTTCAGTTGAAGTCTAAACTC<br>AGGTAACTTGGAATGTATATCATATTGGGATATTAAATATTTCACAGCTA<br>AAAAGCTAAAGAGGGAACATCACTCTTTTGCCTTTCCTTATTTTATGCATT<br>TCCCTTTCCTCATTACATTCCACATTCTTAGAATAAGAAGTGCATTCAATC<br>CTAGGAGAATGATAATCCTGGACATGGGTGAACATGAGGAGAACCAGCA<br>AAATCTGTGGTGTTTGACATCACTTTGTCATGTGGTTACAAGTAAAACAA<br>CTGTTGCATTCACTGTTTCAACATGTGTACATGTGGCTTTTTAAAAGTTC<br>AGGTGTTGCTCAGTAAAGGACTGTGACAATGTTGCAAATAAAGTGTTCAG<br>TACTGGACTGTACATAAACATTCCACATTGTGTGTGATGAAATTTAAGA<br>CAAGAATGTCTAGAGTTAATTTCAAAATAAGTGAAGTGTTTGACGGAATG<br>GTTGAGATTTTTTGTTTATGTTAGCCATCAGGGTCATAACTGTTACCATT<br>TTATCTAAAGACATATTTATATTTAGTTTCTCCCTTGGAAATTCTTTATTTT | SEQ ID<br>NO: 67 |

| Gene Fusion | Chimera Sequence | SEQ ID NO. |
|---|---|---|
| | GCAGGTGAAAAAGTGACATACTTTTTGTTATTGTCTTCCTCAAGCAGTTTA<br>GGTGCATGATCTTCATTTACATAGAATACTTGGGTCTCAGAATTGATGCA<br>ACATAAGCAGGTTTTTTTGGTGACTTACAAGAGCAATAGTTTGAAGCTAT<br>CTCATTTAAGCCTCTCATAATGCATAATCATGAGTAGTTTTGAAATTTGCA<br>ACCTGTGAGGTAGAGCATAAACTCAAGAAAATAGCCTTGAACTTGCAGA<br>CTTTTGACACAAGTTCTCCACAAAGTGTGAAGAGAGCCCCAGGCATTCCT<br>GATTGGTCAATGGGAGAGCCTAACTTTCATTGTTTTCTTCAGTACAAAGA<br>GTATCCAAAAGCTAAGTTTTTGTATTCCACTACTTTCAGTTCAATAAAACC<br>TAGAGTTGTTTCATCTGCGCCTAAAGTGTATGGCACAATTTTCTTAAGAAT<br>TAGGGGAACCAGGTGCCTACAGTTAAAGGAACGTTTCAGTTCCTTTCATT<br>CATTCCTGGGTTTTTCTTTTATTTTCTAAGAAGGTTGAAGAAGGATGAGTG<br>ATAGAGAAGAAAGCAACACCATTGATTTTTTTTTTAAGAAATGATATAT<br>ATATGTATATGTTTGTGTGTGTGTGTGTGTGTGTGTGTATTCTGT<br>GCATTATTTTGTCATGATCTCAATTCTCTTCTTTCCACCAAAGTTTGTCGTA<br>ATATTTTCTCCTGAAGGTGCATTCTGGCTCCTTTAAATTAGTCAGTGTTAT<br>ATTGTAGGAGACTGTCATGGAAAAAAGGACTCAGTTTACTTTCGTCATTT<br>TCACAGGGGAACCTTTTAAAACAATCTTTTCAGCAGCAGATACCTTTAAC<br>CCTAATAATCTCAGGCCTTGATGAAAATACTATATTTTGTAGATTATGGTT<br>AAAGGGGGAAAATTACTAGTTCCGTAAGATAAATATGAGCTCCATTTGAC<br>TTCTGATGTCTGGTTTAGCATTACATAATATGTTGATCTTACACTCTGCTT<br>TTGTCCAAATAAAATGCAATAGTATCAATATCAATTTCAGAAAAATGGAC<br>TGAAATATGCTTTTTTGGTGATGAAATCTCATGTACGATATTTATAGTGATG<br>TGCTTTTATTTTCTCATGAGATACTAAATATTAATTGTGTTGTACATTTGTT<br>CTTAGCATATATTAAAGTTTTGAACCAAATGTGTTAAAGCTTACGCTTTGC<br>CATGTAAATTTCCCAGAAGTTGTTGAGCTCAAATGTATCCTACATCCAGC<br>TGTAGAAATTTGTCAGAAATTGTTTAAATTTTGTATATAATTGTACTGTTT<br>AATTCTAGCCATTGCGCTGAACAGTATTTGAGTTACCATATAATATGGCTT<br>TACACAAGGAAATGTGTGGCTTTTGTTTTGTATTTTTTCAGTATAGAAGTT<br>CCTGTGTCTTATTTAAATAAAGTTATTAGTAAAACTGAAA | |
| ARNT2-><br>MESDC2 | ATGGCAACCCCGGCGGCGGTCAACCCTCCGGAAATGGCTTCAGACATACC<br>TGGATCTGTGACGTTGCCCGTTGCCCCCATGGCGGCCACCGGACAGGTGA<br>GGATGGCGGGGGCCATGCCTGCCCGTGGAGGAAAGCGGCGTTCCGGAAT<br>GGACTTCGATGATGAAGATGGTGAAGGCCCCAGTAAATTTTCAAGAAAG<br>ATGATGACATTGAAGAAGGAGATCTTCCAGAGCACAAGAGACCTTCAGC<br>ACCTGTCGACTTCTCAAAGATAGACCCAAGCAAGCCTGAAAGCATATTGA<br>AAATGACGAAAAAGGGAAGACTCTCATGATGTTTGTCACTGTATCAGG<br>AAGCCCTACTGAGAAGGAGACAGAGGAAATTACGAGCCTCTGGCAGGGC<br>AGCCTTTTCAATGCCAACTATGACGTTCCAGAGGTTCATTGTGGGATCAA<br>CCGTGCTATCTTCATGCTTCGCGATGGGAGCTACGCCTGGGAGATCAAGG<br>ACTTTTTGGTCGGTCAAGCAGGTGTGCTGATGTAACTCTGGAGGGCCAG<br>GTGTACCCCGGCAAAGGAGGAGGAAGCAAAGAGAAAAATAAAACAAAG<br>CAAGACAAGGGCAAAAAAAGAAGGAAGGAGATCTGAAATCTCGGTCTT<br>CCAAGGAAGAAAATCGAGCTGGGAATAAAAGAGAAGACCTGTGA | SEQ ID NO: 68 |
| NAT1-><br>DDHD2 | ACTTCCTCATAGACCTTGGATGTGGGAGGATTGCATTCAGTCTAGTTCCTG<br>GTTGCCGGCTGAAATAACCTGTTAATGATTTTCGCAGTGTTTCCTTGAACT<br>TGCTACAGACACATTTTAAGAAAGCCCAAGAAAATCAGCAGATTGGGAG<br>GGTAGAATTCTTCCAGTCAACTGGCACAGTCCTTTGCATTCTACTGGTGT<br>GGATGTAGATCTGCAGCGAATAACCCTGCCCAGCATTAACCGCCTCAGGC<br>ACTTCACCAATGACACAATTCTGGATGTCTTCTTCTACAATAGTCCCACCT<br>ACTGTCAGACTATTGTGGACACAGTTGCTTCTGAAATGAACCGAATATAC<br>ACACTTTTTCTACAGAGGAACCCTGATTTCAAAGGGGGTGTATCCATTGC<br>TGGTCATAGTTTAGGTTCGCTTATATTGTTTGATATCCTAACAAATCAGAA<br>AGATTCTTTGGGGGATATTGACAGTGAAAAGGATTCGCTAAATATTGTAA<br>TGGATCAAGGAGATACACCTACACTAGAGGAAGATTTGAAGAAACTTCA<br>GCTCTCTGAATTCTTTGATATCTTTGAGAAGGAGAAGTAGATAAGGAAG<br>CTCTGGCTTTATGTACAGACCGAGATCTTCAGGAAATAGGAATTCCTTTA<br>GGACCAAGAAAGAAGATATTAAACTATTTCAGCACCAGAAAAAAACTCAA<br>TGGGTATTAAGAGACCAGCCCCGCAGCCTGCTTCAGGGGCAAACATCCCC<br>AAAGAATCTGAGTTCTGCAGTAGCAGTAATACTAGAAATGGTGACTATCT<br>GGATGTTGGCATTGGGCAGGTGTCTGTGAAATACCCCCGGCTCATCTATA<br>AACCAGAGATATTCTTTGCCTTTGGATCTCCCATTGGAATGTTCCTTACTG<br>TCCGAGGACTAAAAAGAATTGATCCCAACTACAGATTTCCAACGTGCAAA<br>GGTTTCTTCAATATTTATCACCCTTTTGATCCTGTGGCCTATAGGATTGAA<br>CCAATGGTGGTCCAGGAGTGGAATTTGAGCCAATGCTGATCCCACATCA<br>TAAAGGCAGGAAGCGGATGCACTTAGAACTGAGAGAGGGCTTGACCAGG<br>ATGAGTATGGACCTTAAGAACAACTTGCTAGGTTCGCTGCGGATGGCCTG<br>GAAGTCTTTTACCAGAGCTCCATACCCTGCCTTACAAGCTTCAGAAACAC<br>CAGAAGAAACTGAAGCAGAACCTGATCAACTTCAGAGAAGCCTAGTGA<br>TGTTAACACAGAAGAGACCTCTGTGGCAGTTAAAGAAGAAGTCCTGCCTA<br>TCAATGTGGGGATGCTGAATGGAGGCCAACGCATTGACTATGTGCTACAG<br>GAGAAGCCTATTGAAAGTTTTAATGAGTATTTATTTGCTTTACAAAGCCA<br>TCTATGCTACTGGGAGTCTGAAGATACAGTATTGCTCGTCCTCAAAGAGA<br>TCTACCAAACCCAGGGTATCTTCCTTGATCAGCCTTTACAGTAAAAATGA<br>CCCATCTATGGCTGCTTAATACGGACATTGAGGGATCCTTCCCCAGAAAA<br>TCCACCTGTTTGTTGCTGCAATTTTCCTCTCCTCAGCTGCGTCATTTCCTGC | SEQ ID NO: 69 |

TABLE B-continued

| Gene Fusion | Chimera Sequence | SEQ ID NO. |
|---|---|---|
| | ATGTTGCCTGCCACTTACTCACCACTGGGGTCTTTGGAAGATAATCTTCCT<br>CTTTGGAAATGAATGGAAAAGCAAAAGGCCCTATTACTTTTAACCACTGG<br>CTTCATATAAACACTTGCCATTTTTTCTGCATAGCTGGGGGTGGTTTGTG<br>TCTTTAATTCTTTGATGATAGTTTATAGTTGCCACACTTTATTGATTAGTA<br>CTTGACAGGGTGTAAAGCCTATTTTGGGTTTGATTTGTTTTGGGTGGGGTA<br>GACATGTTTTAAGGAACTTATTGCTTATCTTTAGAAAATGTTCTAGTTTG<br>GAAACAGATTCTTGAGATTCAGAAGGCATTTTGGAGTACACTTATCTCTT<br>GTTTGTGTTGAACTGAAGGCTAAGTCTCAGTGGACATGGAAAAGACTTTT<br>GGGTGATTTATTTTTGAACCTGCATTTCTTTCTTATGTGTAGTGTATGAAG<br>AAAGACTAGAATGTAGCTTTAAAAAAGTGTTGTTTACTCTCTTAGAACTG<br>ACAGACTTATTGCCAGAAATCACTGATGTTCATTGTTTTTGCAACTGTTTG<br>AGCTGCTGTAAGAGTCTAAAGTTGACAAGTTAGTTCATGTTAGGTGCATC<br>TTTATAAAGCAAAGATGTTGTATATCCTAGGCCTCCCTTTTATATTTGATA<br>GAAGTTATTTGCTAATAGCTTCTATTCTTACGTTGAAAATAGTTGTAAAAG<br>CTGATGAACCTGAAATTGTGTAGCCTCTACAGGCTGCTGAGGTTCTAAAT<br>AAAACCTTTTAGTGGTGCCTTTATGGTGAAACAGAATTTGTCACCTGCCA<br>TTTCTACTTGAGCTAAGGTAGTATTGTGTATCCTCTTTCCTTCTTAGGTATC<br>CATAATCCACAAAGCATATTTAAAAGGCTCTTGGCACGGGCAGCATTGGT<br>TGAGCAGGTAGGTTTGGCTAGGGGGAAATGTTTAACTTGTTCTGAAAGAA<br>AAACTTATGTCTGTAGGGTCCAAGAAACAGCTATTCCAGAGTCAGTGTCA<br>GCTGAGTCTGGAACATATGAAGTGAGGTTTACTTCTAAGAACACAAGTGA<br>CTGCACACTAATTTTGTCAAGGCATCTTTTCACTACTTTGCTGTAGATTTT<br>TCTTCTTCATTGGTCAGTTTGTCATTGTCTTTGTAGTTCTCTTTATGATAAT<br>CCTTTATACTTGCTCTCAGATTCCACAGGCCTCTGTTTATAGAGTGGCAAA<br>GGCAGGCGAGCTGTGGTTTATTGTTTATAAATTTTTTATAAATGTTATGG<br>TATTCAAAGCCACTGACATTTAATATTTACTGAAGCCATTCCTTAGACAG<br>CAGTGGTCTTTATCCCTTTCTGGAAAGAAAAGGAAAATGAAGGGTAATTA<br>CTGTCACCATGGAGATTGTAGAGGTAAGGTTGGGGTATAGGTCAGGCCTG<br>GCCTTTCTTTGTCATCTGCTTATAGTCTAGTGCTAAGTATGCCACTAAGTT<br>TCAGATATATGGAATACTTTATTTTTTAAAGGTATATAAACTCTGAGTTA<br>TTGAGAATTAAGTATTCACTGTATATTAAGGGGAAGCTTTTGCCAAGTTG<br>TGGTCTTCAAATTTATGTTTACTCTTCCTATTGGCAGAATAGGTGCTATTT<br>AAGAGTAAACCAAAGGATAAGCAGAGGGAGTCCCTATAACCAAAGATGG<br>ACAGCATAGCCCTGGATAGCCAGATAAACCACTCTTTGTATTAAGAAATG<br>TTTCTTTCCTAGTGGTGAGGGGTGGGTAACTGTGAAAGAGCTTTATATCTT<br>GTCTATTCATGGTATTATAGCTGTATATTCCCAGGATGATAAGCTTGATTG<br>AAATCCTGTATTTAGTCATATATTATTTGCGCTGCTTCATTTGTATCATGT<br>GCAATCTCTAGACCAACCCTATTTTTAAACTCTGGTACAGCATCATTTTGT<br>ACATATTCCCAGCTGCAGAACTAGTATCACTTATCTCAGCAAAAGAGATT<br>GTTTGCATGGAAAGATTAATAGCACTGATTAGATTTCTAATATTTTGCATT<br>TTTGAAATGTTTGTTTTCTACGTGATTATATTTAAAACTTTAGTAAATACT<br>AACATGAAACCATAT | |
| ZBTB34-><br>SCAI | CGGGGACTGGCCTGGCGCCGGCGGCGGCGGAGGGGCGCCGCGGGCGGG<br>CGATGTGAGCGCGGCGCTCTGGACAGGACTGAATTTGCTCTTAAAGAAAT<br>CATGTCCTCTGGAGGTGCTGAAGATGATATCCCACAGGGAGAGAGGAAA<br>ACAGTTACAGATTTTTGTTATCTTCTGGATAAATCTAAGCAACTGTTCAAT<br>GGGTTAAGAGATTTGCCACAATATGGACAGAAGCAGTGGCAGTCCTATTT<br>TGGAAGAACTTTTGATGTTTACACCAAACTCTGGAAGTTCCAGCAGCAGC<br>ATCGACAAGTCTTGGATAATCGGTATGGCTTGAAGCGCTGGCAAATAGGA<br>GAAATTGCTTCCAAGATTGGGCAGCTATACTATCATTATTACTTACGCAC<br>ATCGGAAACCAGCTATCTGAATGAGGCTTTTTCCTTCTATTCTGCAATCAG<br>ACAGAGATCATATTATTCTCAAGTCAATAAAGAGGACAGACCTGAATTGG<br>TAGTTAAGAAGTTACGATATTATGCAAGATTTATAGTAGTTTGTCTTCTTC<br>TCAACAAAATGGATGTTGTAAAGGATCTGGTAAAGGAATTGTCAGATGA<br>AATTGAAGATTATACTCACCGATTTAATACTGAAGATCAAGTGGAATGGA<br>ACTTGGTGCTTCAAGAAGTAGCAGCTTTCATTGAGGCGGATCCTGTAATG<br>GTATTAAATGATGATAATACCATTGTTATCCACATCGAATCGCCTTGCTGA<br>AACAGGGAGCCCCATTGCTGGAACAGGGCATGATTGTGGGACAGTTGTCTC<br>TGGCTGACGCACTCATTATTGGTAATTGTAATAATCAGGTTAAGTTCAGT<br>GAACTAACTGTTGACATGTTCCGGATGTTACAAGCTCTGGAAAGGGAGCC<br>AATGAATTTAGCTTCCCAGATGAATAAACCAGGAATGCAGGAATCAGCT<br>GACAAGCCTACTAGACGAGAAAACCCCCACAAGTATCTGCTCTACAAAC<br>CAACCTTCAGCCAGCTATATACCTTCTTAGCAGCGTCTTTTAAGGGAGCTGC<br>CTGCCAATAGCGTGCTTCTGATTTACCTGTCGGCCACTGGCGTTTTCCCCA<br>CAGGTCGTTCTGATAGTGAAGGTCCTTATGATTTTGGAGGTGTACTTACTA<br>ATAGTAACCGGGATATTATTAATGGAGATGCCATCCACAAACGAAATCA<br>GTCCCACAAGGAAATGCACTGCCTTCATCCCGGGGATCTCTATCCTTTCA<br>CCAGGAAGCCACTGTTCATCATTGTGGATTCGTCTAATAGTGTTGCGTAT<br>AAGAATTTCACAAACTTGTTTGGACAGCCACTAGTCTGCTTGCTTTCTCCT<br>ACAGCATATCCAAAAGCTTTACAAGATCAATCTCAGCGAGGTAGCCTCTT<br>CACTCTCTTTTTGAACAATCCTCTAATGGCCTTCCTATTTGTCTCTGGATTG<br>TCAAGCATGCGCAGAGGCCTATGGGAAAAGTGTCAAGAATATCTTCGAA<br>AAATCAACCGTGATATTGCCCAGCTACTGACTCATTCACGTTCAATAGAT<br>CAGGCATTTCTCCAGTTTTTTGGAGATGAATTTCTTCGCTTGCTCCTCACA<br>AGATTTATCTTTTGTTCAGCCACCATGAGGATGCACAAGATTTTTCGGGA<br>AACACGAAATTATCCAGAATCATATCCACAACTGCCAAGGGATGAAACA | SEQ ID NO: 70 |

TABLE B-continued

| Gene Fusion | Chimera Sequence | SEQ ID NO. |
|---|---|---|
| | GTGGAGAATCCTCATCTCCAGAAGCACATTTTGGAATTAGCATCCATTCT<br>GGATGTTCGAAACGTGTTCTTTGAGAATACCATTGATGACTATTAAAACA<br>AAAACCCTGTTGTCGAAACAAGTTTTCATTTTCCACAAATTTTAAATGGTG<br>CAGTTTTCTAACGTGATAAGACACATAGTGGTGTTACTTAGTTTTTATTTT<br>TTAATTTAGGGCCACCATTTTAAAAACAAACAAAAAAATGTTCACACTTT<br>TAGGGTAACTGTTTTAAAATGCAACCTTTCAGGTCTTTTAAAATCTTAACC<br>TTGGAATTTTTATTTTTGATTTTGAGGGATGGATATTTACCTCCAACTTCT<br>AATCCTACACTCAAATAGTCACTATTCTCACCCTGAGAAGAGTAAATCAT<br>TTATTTTTGTATAATGAGGTAAATCCAACTCTTATACTTGGACCTAAGTTA<br>AATGTCTGGATTTGGAAATATGTAATGGTTCATAATGATGAAGCTAGCCA<br>CCATGGACTACTGAAAATCAAGAACAGAGTCCCTCCATAATATATTTTTT<br>CTCATTCCAACTTAGCTGGTAGAAAAATGTTTGATCCTTTGAAACATGAT<br>CAAGCCAGTTTTTTGAAATCATTTAATTTCTTTCAATACTGTCATAATTTC<br>AGAAATTGGATTGAATTGCATCTGAAAGCTACATCTTGATTGAGGACTTG<br>AGGTGGTAATATTACTTGGAATGTATGAGTATTATGAGATTTATTTGCAT<br>ATTTTCTTTGTAGTCTGTGAATGCTGGAAATGAAAAGGAAACAACTTTG<br>AAATATTTTAGTCAAAAACCATGTCATTGGTTTCATAATACAATGTCTCC<br>AATAGGAATTCTATTTAAACTCTTGGTTTATGAGATCACATTTAAAGACT<br>GGATTGATGTCTGTGACATAAAGTTTTAATTTTTTGCCTCATTCAAATTTA<br>TGAGACTTCAAAGTCATAGATGTTTTAAATTTTGGTAAGGGGTAACTGGG<br>TGTTATGAAACCTAAAATGTAAGTTGATTTTGCATTGGTAATTTGGAAAT<br>AAGATTTATTAACATTCCCTGTATTTAGTATTTTATATTCATGCACAAAAT<br>TTTTATTATCTTAAATAGGACTCAGTGTATATTATAAAGATTTTTCTTTTTT<br>GTGTTTTCCTTCCCTGTCATTCCCTTTATAATTTCACAGTCACTTGCTATGA<br>AGTCCTCCCTCCTTTTTGATTATGCAGCATTCAATTTCAGAAATCTATGAA<br>TGAGAAGGCCTTATACCTAATTTTCTGTACAGGATCACATCTGGCAGTCC<br>CAGGAGAAGTGAGCTGATTGCTTTTGATATCTCTTTCCCATGGCCCTAGGT<br>AAATTATACTCTAAATTTATTTATTTTTTTTGAAACAGAGTCTTGCTTTTGT<br>TGCCCAGGTTGGAGTGCAGTGGGGCTATCTCGGCTCACTGCAACCTCCGC<br>CTCCCAGGTTCAAGCAATTTTCCTGCCTCAGCCTCCCGAGTAGCTGGGATT<br>ACAGGTGCCCGCCACCATGCCTGGCTAATTTTTGTATTTTTAGTAGAGAC<br>GGGGTTTCACCATGTTGGTCAGGCTGGTCTCAAACTCCTGACCTTGTGATC<br>TGCCTGCCTCAGCCTCCCAAAGTGCTGGGATTACAGGCGTGAGCCACCGC<br>ACCTGGCTATTATTTTTAACTTGGTTTTCATTTCTGGCATAGAGACTAATT<br>TGGGTCTAAGTTATTCCCATTCCTGCTTTGATTTGCTGATTTTTCAAACCT<br>GAAGTCCAAAGTTACTGTTTTTGGGGTTTGGGGACTTGGGGAGTATTTTA<br>CTTTTTTTTTTTTTTTTTTTAAGAGACAGAGTCTTGCTTTGTTGCCCAGGT<br>TGGGGTGCAGCGGTACATTCATGGCTCACTGCAGCCTCAAATTCCTGGAT<br>TCAGGCAATCTTCTCACCTCAGCCTCCCAAGTAGCTGGGACTACAGGCAT<br>GCGCCACCATGCCTGGCTAATTTTCTTTATTTTTTAATTTTTTGTAGAGAC<br>ATGGTCTCACTTTGTTGAGCAGGCTGGCCTCAAACTCCTGGGCTCAAGTG<br>ATCCTCCTGCCTCAACCTCCCAAAGTGCTAGGATTACAGGTGTGAGCCAC<br>TGTACCTGGCCTGTTTACTTTTTAAAAATTTTTTGTTTGTTCTTTCAAACA<br>GTATTTCAGAAAGCTTGGGAAAAGTTACCCTGGAAAGATTTCCTTTGCTA<br>GTGGGTTTTCATTTTCAGGTAAAGACTGCTTTCCTTTTTTTTCAGTATCTTA<br>ATAAACTTCATAGCTTTCCTTTAGTAACAGTGTTCATTGAACTACAGCAAT<br>AGACTATCTTCGGTTTTCTGACCTCTTGTTTCAATTCCCCTTAAGTCCTGTG<br>CCAGTTATGCTCCTACCAACACAGAGTTTCCTGTCCTCTAATGTTTAAAAT<br>AGTATTTACTGTTCTGAGCTTTATCCTCCCCCGTTAAGCATAAAGAACACT<br>GGTCTGAGAACTAGGAGACCTAAGTTCTAGTCCTGGCTTTCCTGGTAACT<br>TAAGCGTTATGCCCTTTGACAACTGTCTTCATGTCTCTGCTTGTTAGCACT<br>CTCATCTGTAAAATGAAGAGGTTGGCCCAGGTCTTCTCCAACTCTGATTCT<br>GTAATTTGGACTCTTGGTTCCAAAAATATTGATTTCCCCACTCCAACCACC<br>AAGAGAACTATTTACCCTGTTTGTAGTGTACACAACCTTTTCTTTTGTAAG<br>TCATATTTACCTAGATTTTGTTCAAGAAAATCTGGGTCCCACTTAGCTGTT<br>TTAGAAACTAGTACAGACAGAGACTCTCCTGAGGAAATTAGAGCTTTTAT<br>GATTAGAAACATGCTTGTCTAAAAATGAGGGTCTTAGAAATCACAACATT<br>GACCCTTATGATGTTGCCCCTTAAGCTAATAGTGTAATTCCTTACTGGTAG<br>TTAAAAATCTAAAGTGGACTGAAGTGATCTTGAATCTTCAAAGAGAGGA<br>AAACTGTGCTGGAAAATGTTATTGTTTCATTGATGCCTTCAAAAAAATGC<br>GTATTAAACAAAGACTATACTCCAGATTTTCTTCTGGGCATTGGGGAAGC<br>AAACAAAATAGACTTAAAAATCCTCATGTTCATGAAGCTTACATTCTAGT<br>AGAAGGAGTAAGGCAATAAACATAAGTAATTTATGTTAGAAAATGTTAA<br>GTAGGATGGAAAAGTGTAGATTATGGTAAGGTAAATCTTTTGTTTGTTTT<br>CTTAAGAGAAGAACAATGTTTAAAAGAGTGATCAAGCAGGGCATGGTGG<br>CATGACCCTATTAGTCCCAGCTACCTGGGAGGCCGAGGTGGGAGGGTCAC<br>TTGAGCCCAGGAGTTTGTGGCTGCAGTGAGCTGTGATTGCACCACTGCAC<br>TCCAGCCTGGATGGCAAAGCAAGACCTCGTCTCTGGAAAAAAAGAAAAG<br>AAAAAGTGATGATCAGGGTAGGCTTCATTAGGAAGGTCACATTTGCATGA<br>ACACTTTGCCTTTTCTTTCTTTTTATGAAAGTTTTAAACATAGTTTTTTTGT<br>TTTTTGTTTTTGAGACGGAGTTTCACTCTTGTTACTCAGGCTGCAGTGTGG<br>TGGCAGGATCTCAGCTCACTGCAACCTCCACCTTCCAGTTTCAAGTGATTC<br>TCCTGCCTCAGCCTCCCCAGTAGCTGGGATTACAGGCATGTGCCACCACA<br>CCCAGCTAATTTTGTGTTTTGAGATGGGGTTTCACCATGTTGGTCAGGCTG<br>GTCTCGAACTCCTGATTTGAGGTGATCCGTTGGCCTCGGCCTCCCAAAGT<br>GCTGGGATTACAGGCATGAGCCACCACGCCCAGCCTAAACATACAGTTTA<br>ATAAATCCTCCTTGTACCTTACCCAGCTTCTGTATTTCTTTAATCAAGGGA | |

TABLE B-continued

| Gene Fusion | Chimera Sequence | SEQ ID NO. |
|---|---|---|
| | GAAGAATTATCTAAAAGGACAGTTGCCCAATGGGCTTGAGCTGATGATA GTGGCAAAGAATTTCATTTTTTAAAAATGCATACCACCTGCCCTTTATAA AAAAATTTAAACCCTAATGTATTTAATTTTATAATTCATAAAAATTTAAAT ATTGGAACTAAGAACAGAGCAAAGCAAAGGGAAAAAGCACTCCTTTGTT TTCAAATTGCACAAACTGTCCCTGGAGATTCTGATAGTCTCTCATCTCTCT TAACTATCACTGTAAACAACATAGAAAGCATAAGACTGCAAGAAGTCAG TTATACACAAAACAAAATGAAGCACAGTGGAATTTTCTCTTTCTTTATCTG TATATTTCTGAAGTTGGTAAAGCAACTATCTTCTCTATTTTACAGAAGAGA AAGCTGAGACCCAAAAAGCTATTCATAGTGATAGAGCTAGAACTAAAAC TCAGATCTCCTCATCTCAGCCCAGTCTTCTCAGTAGCTCAGACTGCTTTCT ATAATGAACAAGAAAGAATAATTAGGGATTTGTATTTTGGCACAAAACA GTATCAAATTTTTATTGTAAAAATCCACAAATCTGACATTTTATCTTTTAT TCTAGCCAGGATGTATTCTTCATTTGCATGTGTGTGTTTCTCTTAGAAAGT GGTGCTCTCAAACCTTTCAAAGCACAGAATTTATTGTACCCTCTTTATTTT TACCAAATTGAAACGTTTCAGGATTTCAGAAGCAAAGTGCAATCCAATTG TGGCTGGAGTTTTCCTGATAGAGGATCCGGGTGGTTCCCTCCCCTCCAACT TCTGGCTACTGCCCTTTATTTCCTTTGTGCAATAGAATTCCCTGAAACAGA TTATGTCGTAATTATACTGATTTAGTCAGGATAATGGGAAAAGCGACAAA TCGGATTTATGTATTAGGTATTATGGAGCTTTCTTTAGCACTCTCCTCCAA GTTTAATCTCTGACATGTGTGATATAGTAACTTTCTGTCTCTGAGAAGCAG TTTGGACCCAGCTGAAAAATTTTATTTATGGAGACTTGTAATCAGCCTGA TATACAGAGAACACTCTGGACTGGAAATATAGTCAGGTACCAAGGTCTGC TAATTTGGCCATTGCCAGTGATTCAAAACCACCTCCCCACCCTGAGTAAA AGATTTGATATGAATATGAATGCTATGAGTCTCCTGGTGATGTTTGGGT GTATATGTTCCTGTGTGTGTTTGGAAATCATAGAGGGTATTTACCTTGAGG GCTCTTTTGTTGACCTTATTTATTTGAAATTCTTATTTTATTTGTAATGGCA TATGTATATTTTTGTGATGCTACATGCAATCTCTGTGTATACTTTTTGTATA TATGTATACATATTTGTAAATATATTGGTATGCAGTGATACAGTATGTGTA TATTATGTACCCATACCCATTGTGGGCTGAATTTATTTAAGTTCTGTGAGG ACATCCTAGTGGCATTGTTCATGCTGCTGTAATTAGGTTGTGGCTGTATCT CATTCATAAGCCTCTATTTTGAGAGGCTTGTGTTTGGATAAAATGGGCTA ATTTGGAGTTGAAATTAGGATATGAAGATCTTAACAGAAAGCTAGATATT TATTCTTAGCTTTAAAATCACCTGCAAATTTTTATTTAAACTGATGATAAA TTAGTGATATAACCTGAAAAACCTAAGTATGTGAAACTGAGACACCAGC AGATTCTTAGGCTGTAGTAGTCCTTTATTTTCTTGATCCATATTTAAGTAT TATTACTGAGTAGTAAATTATGTATATTGGGGCTTAATAGAGAGGCTGTG GAAAAAAATTGCTTTAATCACATTTAAAAACATAGGAAAATGTCCATTAA ATAGGGGAAATATATTCCCAGTTGTCATTTTTATGCCTCATACTGAATTTT GATTTTGGAACAATTCTTTTTTCATCAGTGTTTTATGTGTCTCTATGAGGC AGAAAAGGGGGCATTAGCTAAGGGATGGCCTAACCTAAGTAGGATAGGA TTTAGTGAGGAACGGGAGGTTGTTAATTTGTATATTTGCAGCAGCTATGA TTAATTTAGTCCTGTCTTGGCATTTCCGGCTACAGATTTTTCTTACTGGA CTTGCATATCAAAGGTGAGTAGGCTCATCTGAGAAAATGCTTCCACTGAA TAAAATGCCTTCACTCGTATTGCTGTGTCTCTATGAGACCACTTGTGTTCT GCAAGTTGATGATATATTCGCACATGAAGTAGAGTTTTTAATATTAGATG CATGGTGTGCTATAAAAATCTGGGCCTTCAAACCTCTCCCAAGGATGATA GGGTTGGGGAGGATAAGAGGATAGTAAATACGTGCAATGCCAATTTGTG AACCTATAGAATGTTGCCAAGTATCAATGTTTGGTTACTTCAGTTGACAT ATTTATTTGCATGAAAGAGTGTAGGAGATGTTTAATATACACTTAAATAC ATTCACTGCAGAAATTAAGTAGAGGTTATTTTTGCATGATAAAATATAAC TGCAAAGCAACTTTTTACACCGTATTCTTTGGAAGATTAAATCTATCTGAT CCAATATTATCTTAAAATAGAGAAATTATCTCAGGAGTCTGTTTTACCAC CCAAAAAAATGTTACATTTGCTGATTCATTATATTTTAAATAAAACAGCC AACTATTCATAAGACTTTTCAATTATAGTATTAAATTCAGAAATAATTATA ACAGCATTTTTCTTGAATAAATATTAAAATTTGGTAATTTATTATTTCTGA AAAATCAGTGAAAACATCCATAGGATCTGATGGTTTGTTGTTTGAATAAC CAAATCATTGTTTTTGCACTGGAGAGTAGTAGAGCAGATATTATACCATT TAAAATTCATGGAACTGACTCAGGCTCCTTGTGGATATTAATTTGAGGAC AGTAGTGGTAATCAAAAGTACAGTAGAAAACACTTGACATTGTGAATGT GACCTCTGACCCCAACCGTTGTAAAGCCAATAACTTTGAGGGTGAATAAG GTAACACTTGCTTAGAAAACCCAGCCCTTTCCCCAGTCTCCTGCGCTCTT ATACATTGATACTTTACAACTATTTTGCTGTACCTCTCAGTCTTTCCTGG ATAATGGGACCACTTAAAAAAAAAAGTGATTCATCTTCCTCAAACTAGAA TTTCAAAGCCTAATACTACACTATGTTCCAGCTTCACTGAGTTTTGAACAA AAAGACTTAAGCATGCCTTGTGTTTAAGGAAAAATAATTGATGTGTGAAT GGAATCAATCACCTATTGACGGGAAGGGTGTCAGGATGATGTAGGGTGA TATGCCTTTAATTGGATAAAGAGAACTGTATTAAGTATAACTAATTTAAT AACTGATTGAAGCACCATTCTTAATTTTAAAATATTTTTGTTAATTTCTTTT GTGGTTTTAAAAATTAATAATTTTTTTTTTTGAGATGGAGTTTTGCTCGT TGCCCAGGCTGGAATGCAATGGCGCGATCTCAGCTCACTGCAACCTCCGC CTCCTGGGTTCAAGAGATTCTCCTGCCTCAGCCTCCCAAGTAGCTGGGAT TACAGGCGTGTGCCACCACGACCAGCTAATTTTGTATTTTTAGTAGAGAT GGGGTTTCACCATGTTGGCCAGGTTGGTCTCGAACTCCTGACCTCAAGTG ATCCACCCGCCTCGGCCTCCCAAAGTGCTGGGATTACAGGTGTGAGCCAC TGTGGCCGGCCTAAAAAAAATTCTTTTTAATAGTTATCAGACTACTTTAAC CAGTGCCATGTTTAAACATACTTGGACAATAGACTCAGTTTTTTTAATAGT TTGAAGTACATTATATTAAAACTACAAACTCACTTATTCAAGCCTAAATTT | |

TABLE B-continued

| Gene Fusion | Chimera Sequence | SEQ ID NO. |
|---|---|---|
| | CATCATAGACTATAAATTGGGTATCAATTTCCTATTTTGGTGGACAATTCC<br>AGTCTGTCTACTACGACAATCATCTTTTTAGGTGTAATATTGTTTAAGACA<br>TAGGTAATTTTAGGTTTTATACTTTTCTCCTAGGCTTATGGAATGAAAGCT<br>AATAGGATATCACTTTCAGAATGAAATAGGGAATTATGGCTAGCCTTCTT<br>ATAGGGCTGCCGTAAATGATACTTAAATGTTTGTTATATCACTGATTTTCT<br>TTTCTCTTCTGAAGCTGTTGTGAATGTCCACTTTGCCATGATTAAAAGTTG<br>AGATTTGTAAACATTACAATTTGAACCATAAATTTTCTCAAACATGAAAT<br>CAGTATGAATAAGTATAAAATTTGAAATGATCATACATGAGAATCCCAAA<br>AGTAAATACTTCCAAACCATAGAGGGATAACCACTGTATTTTAAAAAGC<br>TTATTTCCACCCTTAAAGAAGCATGCTACTAATTGCTTTTTTTCTAAATTA<br>AAACTATGTACTGTGGTAAATTAAAAAATCTGCAGGAAAAATTGCTTAGTG<br>TTTTAGCACAATAAGAATTTTTATTACTCAGGAGTTGGAGACCAGTCTGG<br>GCAATACAGTGAAACCCTGTCGCTACTAAAATACAAAAAAAAAAAAAA<br>AAAAAAAAAATTAGCCAGGCATGGTGGTGTGCGCCTGTAATCCCAGCTA<br>CTTGGGAGGCTGAGGCAGGAGAACTGCTTGTAACCTGGGAGGCGGAGGT<br>TGCAGTGAGCCGAGATCGTGCCATTGCACTCCAGTCTGGGTGACAGAGCA<br>AGACTCATTCTCAAAAAAAAAAAAAAAGGAATTTTTATTACTATTTCCT<br>GAAGAATGGTTTTGTTAACTTGTTACTGTATCATTAAAAAGACCTTCTAA<br>TGGTTCAGTACAATAATCTAGAACTTGATTTATGTGGCTTTTTATAGTTAT<br>CTGAATGCATTCCTTTTGCCACATAGACCATATGGCTAGTTCTCCAACTTT<br>TTTGCTTATTTTTAATAAACCTTGCTGTTCAACAATCAGAGAAACCTTTAG<br>ATTTTGGATGATTCTTCCAGTTGAGGTAGAAACATCTTAGATAATAGGAA<br>AGGCAAATACAAAGTCCTAACATTTTCATAGTAGAGTTTACAAGTAAAAT<br>AACTTATCCATATAGGTTATCTTCGTTGTGTAGCACCAGTATAAATAGTG<br>ATTTCATTAATCATTGAATCAGATGAAGCAGTTATAAATCACTTTTTACTT<br>TGTGCTAAGAATTATTGTAATTTCAGGACACTTTATTATTTCCTCTGAGCA<br>GTTTCCATTGGAAGGTTGAGTTTCCCTTTTTTAAGTTCTAATCATCACTAA<br>AGGTTAAGATAATCAAATAGGAGTTAAAATAAGTTATGTTTGATCTTTTT<br>CCCTTGAAAATAATGCTGAACTTATTGTCTACATTCTGATTATTAGGCAGA<br>AATGCACTTGTTTAAATCATAGAAGTAATTCATTTGGAGGATATAATTAC<br>TCGATTTTCTAGTGGTGTGAAATACTTTTTAACAATTGTGCTTGTCTGTAA<br>CTGAAATGTTATAGAATTTTAACACTATAGGGATTATAGAGTTATATTAG<br>CTCTCCTCAAGAGACTGAAGCACAATATTTTTCATGTAACAATTCTTATCC<br>AAGTGCTGCTAATCTGTCGTGCAAATAATGAAGCTATTTGGTTGCCTATTT<br>AGCTATTCACAAATCACTGTAATCTTTGAAACAATCTTGTCGTTCATTTGT<br>ATTAATATTTGGATATTGTGAGTTAATACTTTAGAAAAAAATCCATCAAC<br>TCAGCCCCGTTAGCAAAACTGTTTGGATTCATAGTTTTTATATGTGTTAAC<br>AGTAGAATAAATTTTGAAGGGCTATTTACTACCAATGACTAAGGGGAA<br>AATTATACTGTCACTATCATTTGACTTGAACATTTGTGGTATTGTAAAAGT<br>CTTGTCAGTTGTGTTCTAAATTGCTTAAGCCATACGTTCTCTTAAACAGGA<br>TGTTTTTTTCTTCCTTTCCAGCAGCCTTTTTCTTCTTTGTCTGTTATGGTTAA<br>TACTCCATAGATTTTAGAAATTGAGAAGTTCTTGAAACATTTTATTTTCTT<br>GAGTTCATCACTTTTGACTCTTGTATGAGATGTGATTTGTCATAAAAGATA<br>GCCTTCCACTACTTCACTAAATGAATTTCAGAGTAAACACTGTGATTCTGC<br>AGAGCGGATTCAGTAGGCTTTCCAATGTTTTCTCCTGCTATACAGTGCCTA<br>CCACCTTGAGGGCACTTCAGTACTAGAGGATGAAAACTGAAACGTTGTTT<br>TGATGTTTATTGAATAACGAGATTAGAGAATATTTGATTTTTGTTGTCAGT<br>GTATTAAAGAAATTTTCACATTGATAAATGTTCTCTAGGAATGTGTCTAC<br>ATTCATCAGGTGTGAACTCTTGTACATGAATTTTGTACCTTGAATCCACAT<br>ATATATTAAGTGTATCATCAATATAAAAATAAACATTATTTGCTTAA | |
| ATRX-><br>RPS6KA6 | ATGACCGCTGAGCCCATGAGTGAAAGCAAGTTGAATACATTGGTGCAGA<br>AGCTTCATGACTTCCTTGCACACTCATCAGAAGAATCTGAAGAAACAAGT<br>TCTCCTCCACGACTTGCAATGAATCAAAACACAGATAAAATCAGTGGTTC<br>TGGAAGTAACTCTGATATGATGGAAAACAGCAAGGAAGAGGGAACTAGC<br>TCTTCAGAAAAATCCAAGTCTTCAGGATCGTCACGATCAAAGAGGAAACC<br>TTCAATTGTAACAAAGTATGTAGAATCAGATGATGAAAAACCTTTGGATG<br>ATGAAACTGTAAATGAAGATGCGTCTAATGAAAATTCAGAAAATGATATT<br>ACTATGCAGAGCTTGCCAAAAGGTACAGTGATTGTACAGCCAGAGCCAG<br>TGCTGAATGAAGACAAAGATGATTTTAAAGGGCCTGAATTTAGAAGCAG<br>AAGTAAAATGAAAACTGAAAATCTCAAAAAACGCGGAGAAGATGGGCTT<br>CATGGGATTGTGAGCTGCACTGCTTGTGGACAACAGGTCAATCATTTTCA<br>AAAAGATTCCATTTATAGACACCCTTCATTGCAAGTTCTTATTTGTAAGAA<br>TTGCTTTAAGTATTACATGAGTGATGATATTAGCCGTGACTGCAGATGGAA<br>TGGATGAACAATGTAGGTGGTGTGCGGAAGGTGGAAACTTGATTTGTTGT<br>GACTTTTGCCATAATGCTTTCTGCAAGAAATGCATTCTACGCAACCTTGGT<br>CGAAAGGAGTTGTCCACAATAATGGATGAAAACAACCAATGGTATTGCT<br>ACATTTGTCACCCAGAGCCTTTGTTGGACTTGGTCACTGCATGTAACAGC<br>GTATTTGAGAATTTAGAACAGTTGTTGCAGCAAAATAAGAAGAAGATAA<br>AAGTTGACAGTGAAAGAGTAATAAAGTATATGAACATACATCCAGATT<br>TTCTCCAAAGAAGACTAGTTCAAATTGTAATGGAGAAGAAAAGAAATTA<br>GATGATTCCTGTTCTGGCTCTGTAACCTACTCTTATTCCGCACTAATTGTG<br>CCCAAAGAGATGATTAAGAAGGCAAAAAACTGATTGAGACCACAGCCA<br>ACATGAACTCCAGTTATGTTAAATTTTTAAAGCAGGCAACAGATAATTCA<br>GAAATCAGTTCTGCTACAAAATTACGTCAGCTTAAGGCTTTTAAGTCTGT<br>GTTGGCTGATATTAAGAAGGCTCATCTTGCATTGGAAGAAGACTTAAATT<br>CCGAGTTTCGAGCGATGGATGCTGTAAACAAAGAGAAAAATACCAAAGA | SEQ ID NO: 71 |

TABLE B-continued

| Gene Fusion | Chimera Sequence | SEQ ID NO. |
|---|---|---|
| | GCATAAAGTCATAGATGCTAAGTTTGAAACAAAAGCACGAAAAGGAGAA | |
| | AAACCTTGTGCTTTGGAAAAGAAGGATATTTCAAAGTCAGAAGCTAAACT | |
| | TTCAAGAAAACAGGTAGATAGTGAGCACATGCATCAGAATGTTCCAACA | |
| | GAGGAACAAAGAACAAATAAAAGTACCGGTGGTGAACATAAGAAATCTG | |
| | ATAGAAAAGAAGAACCTCAATATGAACCTGCCAACACTTCTGAAGATTTA | |
| | GACATGGATATTGTGTCTGTTCCTTCCTCAGTTCCAGAAGACATTTTTGAG | |
| | AATCTTGAGACTGCTATGGAAGTTCAGAGTTCAGTTGATCATCAAGGGGA | |
| | TGGCAGCAGTGGAACTGAACAAGAAGTGGAGAGTTCATCTGTAAAATTA | |
| | AATATTTCTTCAAAAGACAACAGAGGAGGTATTAAATCAAAAACTACAG | |
| | CTAAAGTAACAAAAGAATTATATGTTAAACTCACTCCTGTTTCCCTTTCTA | |
| | ATTCCCCAATTAAAGGTGCTGATTGTCAGGAAGTTCCACAAGATAAAGAT | |
| | GGCTATAAAAGTTGTGGTCTGAACCCCAAGTTAGAGAAATGTGGACTTGG | |
| | ACAGGAAAACAGTGATAATGAGCATTTGGTTGAAAATGAAGTTTCATTAC | |
| | TTTTAGAGGAATCTGATCTTCGAAGATCCCCACGTGTAAAGACTACACCC | |
| | TTGAGGCGACCGACAGAAACTAACCCTGTAACATCTAATTCAGATGAAG | |
| | AATGTAATGAAACAGTTAAGGAGAAACAAAACTATCAGTTCCAGTGAG | |
| | AAAAAAGGATAAGCGTAATTCTTCTGACAGTGCTATAGATAATCCTAAGC | |
| | CTAATAAATTGCCAAAATCTAAGCAATCAGAGACTGTGGATCAAAATTCA | |
| | GATTCTGATGAAATGCTAGCAATCCTCAAAGAGGTGAGCAGGATGAGTC | |
| | ACAGTTCTTCTTCAGATACTGATATTAATGAAATTCATACAAACCATAAG | |
| | ACTTTGTATGATTTAAAGACTCAGGCGGGGAAAGATGATAAAGGAAAAA | |
| | GGAAACGAAAAAGTTCTACATCTGGCTCAGATTTTGATACTAAAAAGGGC | |
| | AAATCAGCTAAGAGCTCTATAATTTCTAAAAAGAAACGACAAACCCAGT | |
| | CTGAGTCTTCTAATTATGACTCAGAATTAGAAAAAGAGATAAAGAGCATG | |
| | AGTAAAATTGGTGCTGCCAGAACCACCAAAAAAAAGAATTCCAAATACAA | |
| | AAGATTTTGACTCTTCTGAAGATGAGAAACACAGCAAAAAAGGAATGGA | |
| | TAATCAAGGGCACAAAAATTTGAAGACCTCACAAGAAGGATCATCTGAT | |
| | GATGCTGAAAGAAAACAAGAGAGAGAGACTTTCTCTTCAGCAGAAGGCA | |
| | CAGTTGATAAAGACACGACCATCATGGAATTAAGAGATCGACTTCCTAAG | |
| | AAGCAGCAAGCAAGTGCTTCCACTGATGGTGTCGATAAGCTTTCTGGGAA | |
| | AGAGCAGAGTTTTACTTCTTTGGAAGTTAGAAAAGTTGCTGAAACTAAAG | |
| | AAAAGAGCAAGCATCTCAAAACCAAAACATGTAAAAAAGTACAGGATGG | |
| | CTTATCTGATATTGCAGAGAAATTCCTAAAGAAAGACCAGAGCGATGAA | |
| | ACTTCTGAAGATGATAAAAAGCAGAGCAAAAAGGGAACTGAAGAAAAA | |
| | AAGAAACCTTCAGACTTTAAGAAAAAAGTAATTAAAATGGAACAACAGT | |
| | ATGAATCTTCATCTGATGGCACTGAAAAGTTACCTGAGCGAGAAGAAATT | |
| | TGTCATTTTCCTAAGGGCATAAAACAAATTAAGAATGGAACAACTGATGG | |
| | AGAAAAGAAAAGTAAAAAAATAAGAGATAAAACTTCTAAAAAGAAGGA | |
| | TGAATTATCTGATTATGCTGAGAAGTCAACAGGGAAAGGAGATAGTTGTG | |
| | ACTCTTCAGAGGATAAAAAGAGTAAGAATGGAGCATATGGTAGAGAGAA | |
| | GAAAAGGTGCAAGTTGCTTGGAAAGAGTTCAAGGAAGAGACAAGATTGT | |
| | TCATCATCTGATACTGAGAAATATTCCATGAAAGAAGATGGTTGTAACTC | |
| | TTCTGATAAGAGACTGAAAAGAATAGAATTGAGGGAAAGAAGAAATTTA | |
| | AGTTCAAAGAGAAATACTAAGGAAATACAAAGTGGCTCATCATCATCTG | |
| | ATGCTGAGGAAAGTTCTGAAGATAATAAAAAGAAGAAGCAAAGAACTTC | |
| | ATCTAAAAAGAAGGCAGTCATTGTCAAGGAGAAAAAGAGAAACTCCCTA | |
| | AGAACAAGCACTAAAAGGAAGCAAGCTGACATTACATCCTCATCTTCTTC | |
| | TGATATAGAAGATGATGATCAGAATTCTATAGGTGAGGGAAGCAGCGAT | |
| | GAACAGAAAATTAAGCCTGTGACTGAAAATTTAGTGCTGTCTTCACATAC | |
| | TGGATTTTGCCAATCTTCAGGAGATGAAGCCTTATCTAAATCAGTGCCTG | |
| | TCACAGTGGATGATGATGATGACGACAATGATCCTGAGAATAGAATTGCC | |
| | AAGAAGATGCTTTTAGAAGAAATTAAAGCCAATCTTTCCTCTGATGAGGA | |
| | TGGATCTTCAGATGATGAGCCAGAAGAAGGGAAAAAAAGAACTGGAAAA | |
| | CAAAATGAAGAAACCCAGGAGATGAGGAAGCAAAAAAATCAAGTCAATT | |
| | CTGAATCAGATTCAGATTCTGAAGAATCTAAGAAGCCAAGATACAGACA | |
| | TAGGCTTTTGCGGCACAAATTGACTGTGAGTGACGGAGAATCTGGAGAA | |
| | GAAAAAAGACAAAGCCTAAAGAGCATAAAGAAGTCAAAGGCAGAAAC | |
| | AGAAGAAAGGTGAGCAGTGAAGATTCAGAAGATTCTGATTTTCAGGAAT | |
| | CAGGAGTTAGTGAAGAAGTTAGTGAATCCGAAGATGAACAGCGGCCCAG | |
| | AACAAGGTCTGCAAAGAAAGCAGAGTTGGAAGAAAATCAGCGGAGCTAT | |
| | AAACAGAAAAAGAAAAGGCGACGTATTAAGGTTCAAGAAGATTCATCCA | |
| | GTGAAAACAAGAGTAATTCTGAGGAAGAAGAGGAGGAAAAGAAGAGG | |
| | AGGAGGAAGAGGAGGAGGAGGAAGAGGAGGAGGAAGATGAAAAT | |
| | GATGATTCCAAGTCTCCTGGAAAAGGCAGAAAGAAATTCGGAAGATTC | |
| | TTAAAGATGATAAACTGAGAACAGAAACACAAAATGCTCTTAAGGAAGA | |
| | GGAAGAGAGACGAAAACGTATTGCTGAGGGGAGCGTGAGCGAGAAAA | |
| | ATTGAGAGAGGTAAATGGTCTTAAATGGTTGATGAGCCAATGGAAGAG | |
| | GGAGAAGCAGATTCTTGTCATGATGAAGGAGTTGTTAAAGAAATCCCTAT | |
| | TACTCATCATGTTAAGGAAGGCTATGAGAAAGCAGATCCTGCACAGTTTG | |
| | AGTTGCTCAAGGTTCTTGGTCAGGGGTCATTTGGAAAGGTTTTTCTTGTTA | |
| | GAAAGAAGACCGGTCCTGATGCTGGGCAGCTCTATGCAATGAAGGTGTT | |
| | AAAAAAAGCCTCTTTAAAAGTTCGAGACAGAGTTCGGACAAAGATGGAG | |
| | AGGGATATACTGGTGAAGTAAATCATCCATTTATTGTCAAATTGCACTA | |
| | TGCCTTTCAGACTGAAGGGAAACTGTACTTAATACTGGATTTTCTCAGGG | |
| | GAGGAGATGTTTTCACAAGATTATCCAAAGAGGTTCTGTTTACAGAGGAA | |
| | GATGTGAAATTCTACCTCGCAGAACTGGCCCTTGCTTTGGATCATCTGCA | |
| | CCAATTAGGAATTGTTTATAGAGACCTGAAGCCAGAAAACATTTTGCTTG | |

TABLE B-continued

| Gene Fusion | Chimera Sequence | SEQ ID NO. |
|---|---|---|
| | ATGAAATAGGACATATCAAATTAACAGATTTTGGACTCAGCAAGGAGTC<br>AGTAGATCAAGAAAAGAAGGCTTACTCATTTTGTGGTACAGTAGAGTATA<br>TGGCTCCTGAAGTAGTAAATAGGAGAGGCCATTCCCAGAGTGCTGATTGG<br>TGGTCATATGGTGTTCTTATGTTTGAAATGCTTACTGGTACTCTGCCATTT<br>CAAGGTAAAGACAGAAATGAGACCATGAATATGATATTAAAAGCAAAAC<br>TTGGAATGCCTCAATTTCTTAGTGCTGAAGCACAAAGTCTTCTAAGGATG<br>TTATTCAAAAGGAATCCAGCAAATAGATTGGGATCAGAAGGAGTTGAAG<br>AAATCAAAAGACATCTGTTTTTTGCAAATATTGACTGGGATAAATTATAT<br>AAAAGAGAAGTTCAACCTCCTTTCAAACCTGCTTCTGGAAAACCAGATGA<br>TACTTTTTGTTTTGATCCTGAATTTACTGCAAAAACACCTAAAGATTCTCC<br>CGGTTTGCCAGCCAGTGCAAATGCTCATCAGCTCTTCAAAGGATTCAGCT<br>TTGTTGCAACTTCTATTGCAGAAGAATATAAAATCACTCCTATCACAAGT<br>GCAAATGTATTACCAATTGTTCAGATAAATGGAAATGCTGCACAATTTGG<br>TGAAGTATATGAATTGAAGGAGGATATTGGTGTTGGCTCCTACTCTGTTT<br>GCAAGCGATGCATACATGCAACTACCAACATGGAATTTGCAGTGAAGAT<br>CATTGACAAAAGTAAGCGAGACCCTTCAGAAGAGATTGAAATATTGATG<br>CGCTATGGACAACATCCCAACATTATTACTTTGAAGGATGTCTTTGATGA<br>TGGTAGATATGTTTACCTTGTTACGGATTTAATGAAAGGAGGAGAGTTAC<br>TTGACCGTATTCTCAAACAAAAATGTTTCTCGGAACGGGAGGCTAGTGAT<br>ATACTATATGTAATAAGTAAGACAGTTGACTATCTTCATTGTCAAGGAGT<br>TGTTCATCGTGATCTTAAACCTAGTAATATTTTATACATGGATGAATCAGC<br>CAGTGCAGATTCAATCAGGATATGTGATTTTGGGTTTGCAAAACAACTTC<br>GAGGAGAAAATGGACTTCTCTTAACTCCATGCTACACTGCAAACTTTGTT<br>GCACCTGAGGTTCTTATGCAACAGGGATATGATGCTGCTTGTGATATCTG<br>GAGTTTAGGAGTCCTTTTTTACACAATGTTGGCTGGCTACACTCCATTTGC<br>TAATGCCCCAATGATACTCCTGAAGAGATACTGCTGCGTATAGGCAATG<br>GAAAATTCTCTTTGAGTGGTGGAAACTGGGACAATATTTCAGACGGAGCA<br>AAGGATTTGCTTTCCCATATGCTTCATATGGACCCACATCAGCGGTATACT<br>GCTGAACAAATATTAAAGCACTCATGGATAACTCACAGAGACCAGTTGCC<br>AAATGATCAGCCAAAGAGAAATGATGTGTCACATGTTGTTAAGGGAGCA<br>ATGGTTGCAACATACTCTGCCCTGACTCACAAGACCTTTCAACCAGTCCT<br>AGAGCCTGTAGCTGCTTCAAGCTTAGCCCAGCGACGGAGCATGAAAAAG<br>CGAACATCAACTGGCCTGTAA | |
| TEX10-><br>PICALM | TGCGATCACGTGAGCACAGCAGGGAGGGGGAGGGGCCCTGATTTCCGGG<br>CGGCGGAAGGAGACGCGGCCGCGTGAGGACGAGGCTATTTGAAAACACG<br>CTCCGGGAGCTAGAGCCTGAGGTCGGCGGCGCACGCTGTTGCCCCGTGGG<br>CTTCTGCTCCCTCGCTTGTCTTCTCGGGCTTCTCGCCCCGGCCGCGGCCGG<br>GTCCTCAGACTTAATTCAGTGCACAAATGAGATGAATGTGAACATCCCAC<br>AGTTGGCAGACAGTTTATTTGAAAGAACTACTAATAGTAGTTGGGTGGTG<br>GTCTTCAAATCTCTCATTACAACTCATCATTTGATGGTGTATGGAAATGAG<br>CGTTTTATTCAGTATTTGGCTTCAAGAAACACGTTGTTTAACTTAAGCAAT<br>TTTTTGGATAAAAGTGGATTGCAAGGATATGACATGTCTACATTTATTAG<br>GCGGTATAGTAGATATTTAAATGAGAAAGCAGTTTCATACAGACAAGTTG<br>CATTTGATTTCACAAAAGTGAAGAGAGGGCTGATGGAGTTATGAGAAC<br>AATGAACACAGAAAAACTCCTAAAAACTGTACCAATTATTCAGAATCAG<br>ATGGATGCACTTCTTGATTTTAATGTTAATAGCAATGAACTTACAAATGG<br>GGTAATAAATGCTGCCTTCATGCTCCTGTTCAAAGATGCCATTAGACTGTT<br>TGCAGCATACAATGAAGGAATTATTAATTTGTTGGAAAAATATTTTGATA<br>TGAAAAAGAACCAATGCAAAGAAGGTCTTGACATCTATAAGAAGTTCCT<br>AACTAGGATGACAAGAATCTCAGAGTTCCTCAAAGTTGCAGAGCAAGTT<br>GGAATTGACAGAGGTGATATACCAGACCTTTCACAGGCCCCTAGCAGTCT<br>TCTTGATGCTTTGGAACAACATTTAGCTTCCTTGGAAGGAAAGAAAATCA<br>AAGATTCTACAGCTGCAAGCAGGGCAACTACACTTTCCAATGCAGTGTCT<br>TCCCTGGCAAGCACTGGTCTATCTCTGACCAAAGTGGATGAAAGGGAAA<br>AGCAGGCAGCATTAGAGGAAGAACAGGCACGTTTGAAAGCTTTAAAGGA<br>ACAGCGCCTAAAAGAACTTGCAAAGAAACCTCATACCTCTTTAACAACTG<br>CAGCCTCTCCTGTATCCACCTCAGCAGGAGGGATAATGACTGCACCAGCC<br>ATTGACATATTTTCTACCCCTAGTTCTTCTAACAGCACATCAAAGCTGCCC<br>AATGATCTGCTTGATTTGCAGCAGCCAACTTTTCACCCATCTGTACATCCT<br>ATGTCAACTGCTTCTCAGGTAGCAAGTACATGGGGAGATCCTTTCTCTGC<br>TACTGTAGATGCTGTTGATGATGCCATTCCAAGCTTAAATCCTTTCCTCAC<br>AAAAAGTAGTGGTGATGTTCACCTTTCCATTTCTTCAGATGTATCTACTTT<br>TACTACTAGGACACCTACTCATGAAATGTTTGTTGGATTCACTCCTTCTCC<br>AGTTGCACAGCCACACCCTTCAGCTGGCCTTAATGTTGACTTTGAATCTGT<br>GTTTGGAAATAAATCTACAAATGTTATTGTAGATTCTGGGGCTTTGATG<br>AACTAGGTGGACTTCTCAAACCAACAGTGGCCTCTCAGAACCAGAACCTT<br>CCTGTTGCCAAACTCCCACCTAGCAAGTTAGTATCTGATGCTTGGATTC<br>ATCTTTAGCCAACCTTGTGGGCAATCTTGGCATCGGAAATGGAACCACTA<br>AGAATGATGTAAATTGGAGTCAACCAGGTGAAAAGAAGTTAACTGGGGG<br>ATCTAACTGGCAACCAAAGGTTGCACCAACAACCGCTTGGAATGCTGCAA<br>CAATGGCACCCCCTGTAATGGCCTATCCTGCTACTACACCAACAGGCATG<br>ATAGGATATGGAATTCCTCCACAAATGGGAAGTGTTCCTGTAATGACGCA<br>ACCAACCTTAATATACAGCCAGCCTGTCATGAGACCTCCAAACCCCTTTG<br>GCCCTGTATCAGGAGCACAGATACAGTTTATGTAACTTGATGGAAGAAAA<br>TGGAATTACTCCAAAAAGACAAGTGCTCAAGCAGCAAAATCCTTACTTCC<br>AGCAAAATCCAAACTGCTGTCTCTTAAATCTCTTAAACTCTCTTCTTCCAT | SEQ ID NO: 72 |

TABLE B-continued

| Gene Fusion | Chimera Sequence | SEQ ID NO. |
|---|---|---|
| | TAGAATGCTACAAGTAACTCAGTGAAGGCCCATGAAGGAAATTGGGACT<br>AGTTTATAGGAGAACGTATCAATACAGTTTATAAAGCCAAGAATTGCTAT<br>GATTTAAGACTAAGATCTGTCTTTTTGGTGACTAACCCTTCAATTCTTTCA<br>ACTCCTGTTAATACCCATAATCAGTAACCTATCAAGAAAAGCCCTTATTT<br>GGAAAGTGTGAAATTTGTATTTGGAAAAGCTGCCTGGAGAGAAGAACTG<br>TGTCCTTTACTGTATTTCAACAGGACTCTTTTGGGGGATCAAAATTAAAAT<br>TCCTAATTATGCATTATCTTTCTTTTCTCCAGTCCTCACAAATACAGAAAC<br>AATAACTGAAATTAACTTTTCTTTTTTAAAAAAAATTATATTCAGTTTGC<br>AGTAGACATTCCTTAAGTATTTGTATTTATTTATGATTATCAATTTTACAT<br>AACATTAATATTGTATCAGACCTCCTTATGAAAATGAGTATGGATGTGCA<br>CAGTATGTTTGATTTTTATCCACAAGAATGAATCTGATTCAGAATGCTTTT<br>CTCAGCTGACATACAGAGCACTAAATATTTTAAGGCAAGTCCATAGGTCT<br>GAATCTCTTAAGAATTCTCGGCCTCTGTGGGATTTAGGGAAGCATTATAA<br>ATGCATTAATCCTTATAGTCAATTCTGTGCCTAGGATTTTGCCAGGGAAC<br>AGTTCACTGACTAGGAAAAGCACTACATTTTAAATTCAGCATTAGTGCAT<br>TGGGAAGGATCTTTACTGCTTTGTGCTTGGCATGTCATTATTTTCCATTTG<br>ACATTAGGGCCTTTCCAAAATGAATGTGAGGAATTGCTTTCACTTCAAGA<br>CTTTCCTTCTTTTCACTAAAACTCTAGAAGGTGTTACAAGGGGGAGGGAA<br>GGGGGGCAAAGTCCTTGAACATTTTCTTTGGCTCGTGCCATGTTATGATC<br>ATATACCTTTTAAATAAGGGGAAATAGTATCTTTAAAGTTAATGTCTAGC<br>CAAGAGTTTAGTAAACGAAGAATTAAACTGCACTGTTGATCGGTGCTTTG<br>TGTAAATACATCTTTAACATTTGGGTGGAGAGGGGCCTTAAGAAGGACAG<br>TTCATTGTAGGAAAGCAATTCTGTACATGAGTTTAAGCATTCTTGTTGCAT<br>TGTCTCTGCAGATTCTATTTTTGTTTACAATATTAAAATGTATGTTAGCAA<br>AATGGGTGGATTTTCAAATAAAATGCAGCTTCCACAAAAGTTTTGTTATG<br>GTATTCTGGTCTGAGATGCATTTTCATTTTTCCTTTCTCTTTTTATTATCAA<br>TATTGTCATTTTTCCCTAATAAAATATACCCAGGTGATTATATTTGTTGAT<br>CTAATAACATGGAAGGTTTGTTTTATATGAATTTTCAAAAAGATGTCTCTT<br>TACACTTTTTGTTACCTTGTAGACTCTTATTGATAAATGCAACTACTTATT<br>AAAATTGTTCACTTTTTGTCTTTTGATCAGATGCCTTTAGTCAGGTAAGTT<br>TAAGGGAAAATACGCAGTTTAATGTTTTGGTACATATAATTATGTCTGCC<br>AAAGAAACCTTTGATTGTATCATATTGCCTATTTAGTAGTGCATAGGGTTC<br>AGAGTACATGATAAAGGATCAAAAGCTTTGCATTGATAAGTGTCTCATAA<br>TATTTGCTGTGATTGGAGAAAAAATGTAGTCGTAGCCAATAAATTTTATC<br>AGCTTTTAAGTTTCAGTATTATTAAACCATTTTCATATAAACTGG | |
| FGD5-><br>BTC | ATGTTCAGGGGTCCGAAGCCCCCCATTGCCCCCAAGCCCAGGCTGACTGC<br>CCCAAACGAGTGGAGAGCCAGTGTGTACCTGAATGACAGCTTGAACAAA<br>TGCAGCAACGGGCGGCTGCCCTGTGTAGACAGGGGGCTTGATGAGGGGC<br>CCCGGTCCATCCCAAAGTGCTCTGAGTCGGAGACCGACGAGGATTACATC<br>GTGGTCCCCAGGGTTCCGCTGAGGGAGGATGAACCCAAGGACGAGGGCA<br>GTGTGGGGAACAAAGCCCTGGTGTCTCCCGAGTCCTCTGCGGAAGAGGA<br>AGAGGAGCGTGAAGAGGGAGGCGAGGCATGTGGCCTGGAGGGTACAGG<br>AGCTGGTGAGGATTCAGTGGCCCCTGCTGCTCCGGGTGCAGGAGCGCTGA<br>GCAGGGAGGGTGAGGAAGGCACAGACCTTGCTCTTGAGGATGAAGGGGA<br>GGGCTGCGCTGATGAGCCAGGGACACTGGAGCAGGTGTCCAGAAGTGAG<br>GAGGAAGAGAAGCTAGTGCAGCCACACAGGGAGTGCAGCCTGGAGGAC<br>AGTGGGCCTTGGGCTGGAGAGGGGGTCTTCCAGAGCGACCTCCTCCTGCC<br>TCACATCCATGGAGAGGACCAGGAGCCCCCCGACACCCCGGGGAGGCA<br>GAGGAGGATGATGAGGAAGGCTGTGCCAGCACAGACCCAGCAGGGGCA<br>GATGAGGGTTCGGGTCCTGACAGGCCCACGGAGGACATGGGACAGGATG<br>CTGAGGACACCAGTGAGGAGCCCCCTGAGAAGGAGGAGCTGGCCGGGGT<br>CCAGGAGGCAGAGACAGCCACAGACTGCCCTGAAGTTCTTGAGGAGGGA<br>TGTGAAGAGGCCACGGGTGTCACAGGTGGGGAACAGGTTGACCTCAGTG<br>AACCACCTGACCACGAGAAGAAAACCAACCAAGAAGTGGCAGCCGCCAC<br>CCTGGAGGACCATGCACAGGATGAGTCCGCCGAGGAGAGCTGCCAGATT<br>GTCCCTTTTGAGAATGACTGCATGGAGGACTTCGTGACTTCCCTCACAGG<br>AAGCCCCTATGAGTTCTTCCCAACTGAGAGCACCTCTTTTTGCAGCGAGA<br>GCTGTTCTCCTCTTTCTGAATCAGCGAAAGGTTTAGAATCAGAGCAGGCA<br>CCAAAGCTGGGGCTGCGTGCGGAGGAGAACCCCATGGTGGGGGCTTTGT<br>GTGGCCAGTGTGGCTCCCTACAGGGTGGAGCGGCCGAGGGTCCCGCAGC<br>CCCTGATGTGGTGGTCGTGCTGGAGGAGGAGGCCTTGGATGATGCACTGG<br>CCAACCCCTATGTGATGGGAGTGGGCCTGCCCGGTCAGGCGGCCCCTGGA<br>GAAGGAGGGCAGGCTGCATCGGACGCCCTGGGTGGTTATGGCTCGAAAG<br>AAGAATTGAACTGTGAGGCAGAGGGTGGCCTGGTTCCCGCGGACAGGAA<br>GAACACCAGCACGAGGGTCCGGCCCCACTCTGGGAAGGTGGCCGGCTAT<br>GTCCCAGAAACCGTCCCTGAAGAAACCGGACCTGAGGCGGGCTCGTCAG<br>CCCCTGGCATTGGAGGTGCCGCAGAGGAGGTGGGAAAGACGCTTTTGTC<br>ATTGGAGGGGAAGCCCTTGGAAGCCAGCAGGGCCTTGCCAGCAAAGCCC<br>AGGGCCTTTACTTTATACCCTCGGTCGTTCTCCGTGGAAGGCCGAGAGAT<br>TCCAGTGTCCGTGTACCAGGAGCCTGAGGGGTCAGGGTTGGATGACCACA<br>GGATAAAGAGGAAAGAGGACAATCTCTCTCTGTCGTGTGTAATTGGCTCC<br>TCTGGGAGTTTCTCCCAGAGAAACCACCTTCCGTCAGCGGCACCTCCAC<br>GCCTTCTTCCATGGTCGACATCCCACCTCCTTTCGACCTGGCCTGCATCAC<br>CAAGAAGCCCATCACAAAGAGCTCTCCCTCACTCCTGATCGAGAGCGACT<br>CCCCGGACAAGTACAAGAAGAAGAAGTCATCCTTTAAGCGCTTCCTGGCA<br>CTGACGTTTAAGAAGAAGACGGAGAACAAATTGCATGTGGATGTGAACG | SEQ ID NO: 73 |

TABLE B-continued

| Gene Fusion | Chimera Sequence | SEQ ID NO. |
|---|---|---|
| | TGTCTTCCTCTAGGTCCTCTTCAGAGTCCAGCTACCACGGGCCTTCCAGGA<br>TTCTGGAAGTTGACCGGAGAAGCCTCAGCAACTCCCCTCAGCTTAAGTCT<br>CGGACTGGGAAGCTCCGGGCTTCTGAATCCCCCTCCTCCCTCATCTTTTAT<br>AGAGATGGCAAGAGGAAAGGTGTCCCCTTCAGCAGGACGGTGTCCAGAG<br>TGGAGTCCTTTGAAGACCGCTCCCGGCCGCCCTTCCTGCCCTTGCCACTGA<br>CCAAGCCACGGTCCATCTCCTTCCCCAGCGCTGACACTTCAGACTATGAG<br>AACATTCCAGCCATGAACTCGGACTATGAGAATATCCAGATTCCACCCCG<br>GAGACCTGCCAGGGCTGGCGCGTTCACGAAGCTGTTTGAAGATCAGAGC<br>AGAGCCCTGTCCACAGCAAACGAAAATGATGGCTACGTGGACATGAGCA<br>GCTTCAACGCCTTTGAGAGCAAACAGCAGAGTGCAGACCAGGACGCAGA<br>AAGCGCCTACACAGAGCCCTACAAAGTCTGTCCCATCTCGTCGGCAGCCC<br>CCAAAGAGGACCTTACGTCGGATGAAGAGCAGAGAAGCTCGGAGGAGGA<br>GGACAGTGCTTCAAGAGACCCCAGTGTCACCCACAAGGTGGAAGGACAG<br>TCCAGAGCCCTTGTCATCGCACAGGAACTGCTATCTTCAGAGAAAGCATA<br>CGTGGAGATGCTCCAGCACTTAAATCTGGATTTCCATGGAGCTGTCATGA<br>GGGCCTTGGATGACATGGACCATGAAGGCAGAGACACATTGGCCCGGGA<br>GGAGCTGAGGCAGGGCCTGAGTGAACTCCCAGCCATCCACGACCTTCATC<br>AAGGCATCCTGGAGGAGCTGGAGGAAAGGCTGTCAAATTGGGAGAGCCA<br>GCAGAAGGTAGCTGACGTCTTCCTGGCCCGGGAGCAGGGGTTTGATCACC<br>ACGCCACTCACATCCTGCAGTTCGACAGGTACCTAGGTCTGCTCAGTGAG<br>AATTGCCTCCACTCTCCCCGGCTGGCAGCTGCTGTCCGTGAATTTGAGCA<br>GAGTGTACAAGGAGGCAGCCAGACTGCGAAGCATCGGCTGCTGCGGGTG<br>GTTCAACGCCTCTTCCAGTACCAAGTGCTCCTCACAGACTATTTAAACAA<br>CCTTTGTCCGGACTCCGCCGAGTACGACAACACACAGGGTGCACTGAGCC<br>TCATCTCCAAAGTCACAGACCGTGCCAACGACAGCATGGAGCAAGGGGA<br>AAACCTGCAGAAGCTGGTCCACATTGAGCACAGCGTCCGGGGCCAAGGG<br>GATCTCCTCCAGCCAGGAAGGGAGTTTCTGAAGGAAGGGACGCTGATGA<br>AAGTAACAGGGAAAAACAGACGGCCCCGGCACCTATTTCTGATGAACGA<br>TGTGCTCCTGTACACCTATCCCCAGAAGGATGGGAAGTACCGGCTGAAGA<br>ACACATTGGCTGTGGCCAACATGAAGGTCAGCCGCCCTGTGATGGGAAA<br>AGTGCCCTACGCTCTAAAGATTGAGACTTCCGAGTCCTGCCTGATGCTGT<br>CTGCGAGCCCTCTTCGGAAACGTCGTAAAAGAAAGAAGAAAGAAGAAGA<br>AATGGAAACTCTGGGTAAAGATATAACTCCTATCAATGAAGATATTGAAG<br>AGACAAATATTGCTTAA | |
| HHATL-><br>GRB2 | CAGCAGCTCTGCAGCACTCGGCTCTGCTCCACTCTGCTCAGCTCCGCTCCA<br>GGAAGGCCACCTCCTCCTCCCCCTCCTCCTCCCGCTGTCACCACTCACCGC<br>TCATAACCTCAAGGGGGTGGGGACCCCAGGGCTGGACACACCCCACCGT<br>GGCCCCAGAGCTCAGCCGGTCGCACGGACGGACAGTTGGAAGCCGGACC<br>CCAGAGCCTGAGGTGGGCAGTGTGCCAGGGTCCCTTGCGGCCTCCTCAAG<br>GTTTTGAACGAAGAATGTGATCAGAACTGGTACAAGGCAGAGCTTAATG<br>GAAAAGACGGCTTCATTCCCAAGAACTACATAGAAATGAAACCACATCC<br>GTGGTTTTTTGGCAAAATCCCCAGAGCCAAGGCAGAAGAAATGCTTAGCA<br>AACAGCGGCACGATGGGGCCTTTCTTATCCGAGAGAGTGAGAGCGCTCCT<br>GGGGACTTCTCCCTCTCTGTCAAGTTTGGAAACGATGTGCAGCACTTCAA<br>GGTGCTCCGAGATGGAGCCGGGAAGTACTTCCTCTGGGTGGTGAAGTTCA<br>ATTCTTTGAATGAGCTGGTGGATTATCACAGATCTACATCTGTCTCCAGA<br>AACCAGCAGATATTCCTGCGGGACATAGAACAGGTGCCACAGCAGCCGA<br>CATACGTCCAGGCCCTCTTTGACTTTGATCCCCAGGAGGATGGAGAGCTG<br>GGCTTCCGCCGGGGAGATTTTATCCATGTCATGGATAACTCAGACCCCAA<br>CTGGTGGAAAGGAGCTTGCCACGGGCAGACCGGCATGTTTCCCCGCAATT<br>ATGTCACCCCCGTGAACCGGAACGTCTAAGAGTCAAGAAGCAATTATTTA<br>AAGAAAGTGAAAAATGTAAAACACATACAAAAGAATTAAACCCACAAGC<br>TGCCTCTGACAGCAGCCTGTGAGGGAGTGCAGAACACCTGGCCGGGTCA<br>CCCTGTGACCCTCTCACTTTGGTTGGAACTTTAGGGGGTGGGAGGGGGCG<br>TTGGATTTAAAAATGCCAAAACTTACCTATAAATTAAGAAGAGTTTTTAT<br>TACAAATTTTCACTGCTGCTCCTCTTTCCCCTCCTTTGTCTTTTTTTTCATC<br>CTTTTTTCTCTTCTGTCCATCAGTGCATGACGTTTAAGGCCACGTATAGTC<br>CTAGCTGACGCCAATAATAAAAAACAAGAAACCAAGTGGGCTGGTATTC<br>TCTCTATGCAAAATGTCTGTTTTAGTTGGAATGACTGAAAGAAGAACAGC<br>TGTTCCTGTGTTCTTCGTATATACACACAAAAAGGAGCGGGCAGGGCCGC<br>TCGATGCCTTTGCTGTTTAGCTTCCTCCAGAGGAGGGGACTTGTAGGAAT<br>CTGCCTTCCAGCCCAGACCCCAGTGTATTTTGTCCAAGTTCACAGTAGA<br>GTAGGGTAGAAGGAAAGCATGTCTCTGCTTCCATGGCTTCCTGAGAAAGC<br>CCACCTGGGCTGGGCGCGGTGGCTCACGCCTGTAATCCCAGCACTTTGGG<br>AGGCCAAGGTGGGCGGATCACAAGGTCAGGAGTTCGAGACCAACCTAGC<br>CAACATGGTGAAACCCCGTCTCTACTAAAAATAAGAAATTAGCCGGGTGT<br>GGCACGCACCTGTAGTCCCAGCTACTTGGGAGCCTGAGGCAGGAGAATC<br>GCTTGAACCTGGGAAGTGGAGGTTGAGTGAGCCGGGACCGTGCCATTGT<br>ACTCCAGCCTGGGTGACAGAGCGAGATTCCGTCTCAAAAAAAAAAAAAA<br>AAAGCCCACCTGAAAGCCTGTCTCTTTCCACTTTGTTGGCCCTTCCAGTGG<br>GATTATCGAGCATGTTGTTTTTTCATAGTGCCTTTTTCCTTATTTCAAGGGT<br>TGCTTCTGAGTGGTGTTTTTTTTTTTTTTAATTTGTTTTGTTTTAAAATA<br>AGTTAAAGGCAGTCCAGAGCTTTTCAGCCAATTTGTCTCCTACTCTGTGTA<br>AATATTTTCCCTCCGGGCAGGGGAGCCAGGGTAGAGCAAAGGAGACAA<br>AGCAGGAGTGGAAGGTGAGGCGTTCTCCTGCTTGTACTAAGCCAGGAGG<br>CTTTAAGCTCCAGCTTTAAGGGTTGTGAGCCCCTTGGGGGTTCAGGGAAC | SEQ ID NO: 74 |

TABLE B-continued

| Gene Fusion | Chimera Sequence | SEQ ID NO. |
|---|---|---|
| | TGCTTGCCCAGGGTGCAGTGTGAGTGTGATGGGCCACCGGGGCAAGAGG GAAGGTGACCGCCCAGCTCTCCCACATCCCACTGGATCTGGCTTACAGGG GGGTCGGAAGCCTGTCCTCACCGTCTCGGGGGTTGTGGCCCCCGCCCCCT CCCTATATGCACCCCTGGAACCAGCAAGTCCCAGACAAGGAGAGCGGAG GAGGAAGTCATGGGAACGCAGCCTCCAGTTGTAGCAGGTTTCACTATTCC TATGCTGGGGTACACAGTGAGAGTACTCACTTTTCACTTGTCTTGCTCTTA GATTGGGCCATGGCTTTCATCCTGTGTCCCCTGACCTGTCCAGGTGAGTGT GAGGGCAGCACTGGGAAGCTGGAGTGCTGCTTGTGCCTCCCTTCCCAGTG GGCTGTGTTGACTGCTGCTCCCCACCCCTACCGATGGTCCCAGGAAGCAG GGAGAGTTGGGGAAGGCAAGATTGGAAAGACAGGAAGACCAAGGCCTC GGCAGAACTCTCTGTCTTCTCTCCACTTCTGGTCCCCTGTGGTGATGTGCC TGTAATCTTTTTCTCCACCCAAACCCCTTCCCACGACAAAAACAAGACTG CCTCCCTCTCTTCCGGGAGCTGGTGACAGCCTTGGGCCTTTCAGTCCCAA GCGGCCGATGGGAGTCTCCCTCCGACTCCAGATATGAACAGGGCCCAGG CCTGGAGCGTTTGCTGTGCCAGGAGGCGGCAGCTCTTCTGGGCAGAGCCT GTCCCCGCCTTCCCTCACTCTTCCTCATCCTGCTTCTCTTTTCCTCGCAGAT GATAAAAGGAATCTGGCATTCTACACCTGGACCATTTGATTGTTTTATTTT GGAATTGGTGTATATCATGAAGCCTTGCTGAACTAAGTTTTGTGTGTATAT ATTTAAAAAAAAAATCAGTGTTTAAATAAAGACCTATGTACTTAATCCTT TAACTCTGCGGATAGCATTTGGTAGGTAGTGATTAACTGTGAATAATAAA TACACAATGAATTCTTCA | |
| GOPC-> TRMT11 | ATGTCGGCGGGCGGTCCATGCCCAGCAGCAGCCGGAGGGGGCCCAGGGG GCGCCTCCTGCTCCGTGGGGGCCCCTGGCGGGGTATCCATGTTCCGGTGG CTGGAGGTGCTGGAGAAGGAGTTCGACAAAGCTTTTGTGGATGTGGATCT GCTCCTGGGAGAGATCGATCCAGACCAAGCGGACATCACTTATGAGGGG CGACAGAAGATGACCAGCCTGAGCTCCTGCTTTGCACAGCTTTGCCACAA AGCCCAGTCTGTGTCTCAAATCAACCACAAGCTGGAGAATCGGGACCAGT ATTCACATCTGCTAAGTGATCATTTTCTGCCATACCAAGGTCATAATTCCT TCCGTGAGAAATATTTTAGTGGGGTAACAAAAAGAATTGCCAAGGAAGA AAAATCCACCCAGGAATGA | SEQ ID NO: 75 |
| ZDHHC21 -> HMGB1 | CAGCGGCTCCCATCGCGGCTCCCGGGAGCTAAGCGAGACGGCGACGGCG GCAGTCGTCCCTCCCCACGCGGGCGCGCGGGCATGCGGACACCCACTCGG CCGGTCCAGGCCCTCAGGCTCCCGGAAGCGGAAGGGGAGAGCGGCCCGG CCTGGGCGGCGGCGCCGGAGGAGGCGGAGGTGGCGCGGCAGGAGGAGG GGAAAGAGCTGCTGGCGGTCGGGAGAGCGGCGGCAGCGAGAGGCGAGC CAGCGGCGACGAAAAATAACTAAACATGGGCAAAGGAGATCCTAAGAAG CCGAGAGGCAAAATGTCATCATATGCATTTTTTGTGCAAACTTGTCGGGA GGAGCATAAGAAGAAGCACCCAGATGCTTCAGTCAACTTCTCAGAGTTTT CTAAGAAGTGCTCAGAGAGGTGGAAGACCATGTCTGCTAAAGAGAAAGG AAAATTTGAAGATATGGCAAAAGCGGACAAGGCCCGTTATGAAAGAGAA ATGAAAACCTATATCCCTCCCAAAGGGGAGACAAAAAAGAAGTTCAAGG ATCCCAATGCACCCAAGAGGCCTCCTTCGGCCTTCTTCCTCTTCTGCTCTG AGTATCGCCCAAAAATCAAAGGAGAACATCCTGGCCTGTCCATTGGTGAT GTTGCGAAGAAACTGGGAGAGATGTGGAATAACACTGCTGCAGATGACA AGCAGCCTTATGAAAAGAAGGCTGCGAAGCTGAAGGAAAAATATGAAAA GGATATTGCTGCATATCGAGCTAAAGGAAAGCCTGATGCAGCAAAAAAG GGAGTTGTCAAGGCTGAAAAAAGCAAGAAAAAGAAGGAAGAGGAGGAA GATGAGGAAGATGAAGAGGATGAGGAGGAGGAGGAAGATGAAGAAGAT GAAGATGAAGAAGAAGATGATGATGATGAATAAGTTGGTTCTAGCGCAG TTTTTTTTTTCTTGTCTATAAAGCATTTAACCCCCCTGTACACAACTCACTC CTTTTAAAGAAAAAAATTGAAATGTAAGGCTGTGTAAGATTTGTTTTTAA ACTGTACAGTGTCTTTTTTTGTATAGTTAACACACTACCGAATGTGTCTTT AGATAGCCCTGTCCTGGTGGTATTTTCAATAGCCACTAACCTTGCCTGGTA CAGTATGGGGGTTGTAAATTGGCATGGAAATTTAAAGCAGGTTCTTGTTG GTGCACAGCACAAATTAGTTATATATGGGGATGGTAGTTTTTTCATCTTCA GTTGTCTCTGATGCAGCTTATACGAAATAATTGTTGTTCTGTTAACTGAAT ACCACTCTGTAATTGCAAAAAAAAAAAAAAAGTTGCAGCTGTTTTGTTGA CATTCTGAATGCTTCTAAGTAAATACAATTTTTTTTATTAGTATTGTTGTC CTTTTCATAGGTCTGAAATTTTCTTCTTGAGGGGAAGCTAGTCTTTTGCT TTTGCCCATTTTGAATCACATGAATTATTACAGTGTTTATCCTTTCATATA GTTAGCTAATAAAAAGCTTTTGTCTACACACCCTGCATATCATAATGGGG GTAAAGTTAAGTTGAGATAGTTTTCATCCATAACTGAACATCCAAAATCT TGATCAGTTAAGAAATTTCACATAGCCCACTTACATTTACAAACTGAAGA GTAATCAATCTACTCAAAGCATGGGATTATTAGAATCAAACATTTTGAAA GTCTGTCCTTGAAGGACTAATAGAAAAGTATGTTCTAACCTTTACATGAG GACTCTATTCTTTAACTCCCATTACCATGTAATGGCAGTTATATTTTGCAG TTCCCACATTAAAGAAGACCTGAGAATGTATCCCCAAAAGCGTGAGCTTA AAATACAAGACTGCCATATTAAATTTTTGTTGACATTAGTCTCAGTGAA GACTATGAAATGCTGGCTATAGATGTCTTTTCCCATTTATCTAAATATGG ACTGCTCAGGAAACGAGACTTTCCATTACAAGTATTTTAATTAATTGGG CCAGCTTTTCAAACAAAGATGCCACATTCAAAATAGGGTATATTTTCCTA TATTACGGTTTGCCCCTTTATAAATCCAAGTAGATAGGAAGAAAGAAGAC AAACTTTGCATCTCAGTATGAATTATTCAATTTATTTGAATGATTTTCTTT ACAAAACAAACTCATTCATTAGTCATGTTTATCTGCTTAGGAGTTTAGGG AACAATTTGGCAATTTTGTGGTTTTCGAGATTATCGTTTTCTTAAAGTGCC | SEQ ID NO: 76 |

TABLE B-continued

| Gene Fusion | Chimera Sequence | SEQ ID NO. |
|---|---|---|
| | AGTATTTTAAAATAGCGTTCTTGTAATTTTACACGCTTTTGTGATGGAGTG CTGTTTTGTTATATAATTTAGACTTGGATTCTTTCCATTTGCATTTGTTTAT GTAATTTCAGGAGGAATACTGAACATCTGAGTCCTGGATGATACTAATAA ACTAATAATTGCAGAGGTTTTAAATACTAGTTAAATGGCTTTCACTTAAG AACTTAAGATTTTGTTACATATTTTTAAATCTTGTTTCTAATAATACCTCTT AGCAGTACCTTTTAAATAAGTATAAGGGATGGCAAAGTTTTTCCCTTTAA AAATACTCACTTTATGCTTATAAATAGGTTAATGGGCTGATAAAAGGTTT TGTCAAACATTGCAAGTATTCGGTGCTATATATAAAGGAGGAAAACTAG TTTTACTTTCAGAATGATTTAAACAAGATTTTTAAAAACAAGATACATGC AAGCGAACAGCAGGGTTAGTGATAGGCTGCAATTGTGTCGAACATCAGA TTTTTTGTTAAGAGGAGCAAATGACTCAATCTGATTTAGATGGAAGTTTCT ACTGTATAGAAATCACCATTAATCACCAACATTAATAATTCTGATCCATTT AAAATGAATTCTGGCTCAAGGAGAATTTGTAACTTTAGTAGGTACGTCAT GACAACTACCATTTTTTTAAGATGTTGAGAATGGGAACAGTTTTTTTAGG GTTTATTCTTGACCACAGATCTTAAGAAAATGGACAAAACCCCTCTTCAA TCTGAAGATTAGTATGGTTTGGTGTTCTAACAGTATCCCCTAGAAGTTGG ATGTCTAAAACTCAAGTAAATGGAAGTGGGAGGCAATTTAGATAAGTGT AAAGCCTTGTAACTGAAGATGATTTTTTTTAGAAAGTGTATAGAAACTAT TTTAATGCCAAGATAGTTACAGTGCTGTGGGGTTTAAAGACTTTGTTGAC ATCAAGAAAAGACTAAATCTATAATTAATTGGGCCAACTTTTAAAATGAA GATGCTTTTTAAAACTAATGAACTAAGATGTATAAATCTTAGTTTTTTTGT ATTTTAAAGATAGGCATATGGCATATTGATTAACGAGTCAAATTTCCTAA CTTTGCTGTGCAAAGGTTGAGAGCTATTGCTGATTAGTTACCACAGTTCTG ATGATCGTCCCATCACAGTGTTGTTAATGTTTGCTGTATTTATTAATTTTCT TAAAGTGAAATCTGAAAAATGAAATTTGTGTGTCCTGTGTACCCGAGGGG TAATGATTAAATGATAAAGATAAGAA | |
| SUSD3-> KIAA1429 | ATGCGCTGGGCGGCCGCCACCCTCCGTGGCAAGGCGAGGCCCCGGGGGC GGGCCGGGGTCACCACGCCTGCCCCAGGGAACCGCACAGTTCTTTAAGG AAAAACAGTAGTGCTCTGCATAGTTTACTGAAACGAGTGGTCAGCACATT TAGTAAGGACACAGGAGAGCTTGCATCTTCATTTTTAGAATTTATGAGAC AAATTCTTAACTCTGACACAATTGGATGCTGTGGAGATGATAATGGTCTC ATGGAAGTAGAGGGAGCTCATACATCACGGACGATGAGTATTAATGCTG CAGAGTTAAAACAGCTTCTACAAAGCAAAGAAGAAAGTCCAGAAAATTT GTTCCTTGACTAGAGAAGCTTGTTTTGGAACATTCAAAAGATGATGACA ATCTGGATTCTTTGTTGGACAGTGTAGTTGGACTTAAGCAGATGCTGGAG TCATCAGGTGACCCTTTACCTCTCAGTGACCAGGATGTAGAACCAGTACT TTCAGCTCCAGAATCTCTTCAGAATCTGTTTAACAATAGGACTGCCTATGT GCTTGCTGATGTCATGGATGATCAGTTGAAATCTATGTGGTTCACTCCATT TCAGGCTGAAGAGATAGATACAGATCTGGATTTGGTAAAGGTTGACTTAA TTGAACTCTCTGAAAAATGCTGTAGTGACTTTGATTTGCACTCAGAATTA GAGCGCTCATTTTTGTCAGAACCATCATCTCCAGGAAGAACCAAGACTAC TAAAGGATTCAAACTTGGGAAGCACAAGCATGAGACCTTTATAACGTCA AGTGGAAAATCTGAATACATTGAACCTGCCAAAAGAGCTCATGTTGTGCC ACCACCAAGAGGAAGGGGCAGGGGAGGATTTGGACAGGGTATACGACCT CATGATATTTTTCGTCAGAGAAAACAGAACACAAGTAGACCACCATCTAT GCATGTGGATGACTTTGTTGCTGCTGAAAGTAAAGAAGTGGTTCCTCAAG ATGGAATACCTCCACCAAAACGGCCACTCAAAGTATACAGAAGATTTCT TCCCGTGGTGGGTTTTCAGGCAATAGAGGAGGACGGGGTGCTTTCCACAG TCAGAATAGGTTTTTCACACCACCTGCTTCAAAAGGAAACTACAGTCGTC GGGAAGGAACAAGAGGCTCCAGTTGGAGTGCTCAGAATACTCCTCGAGG AAATTACAATGAAAGTCGTGGAGGCCAGAGCAATTTTAACAGAGGCCCT CTTCCACCATTACGACCCCTTAGTTCTACAGGTTACCGCCCAAGTCCTCGG GACCGTGCTTCTAGAGGTCGTGGGGGACTTGGACCTTCCTGGGCTAGTGC AAATAGCGGCAGTGGAGGCTCAAGAGGAAAGTTTGTTAGTGGAGGCAGT GGTAGAGGTCGTCATGTACGCTCCTTTACACGATAA | SEQ ID NO: 77 |
| GBAS-> PCLO | ATGGCGGCGCGAGTGCTGCGCGCCCGCGGAGCGGCCTGGGCCGGCGGCC TCCTGCAGCGGGCGGCCCCCTGCAGCCTCCTGCCCAGGCTCCGGATTCAG AATGGCTTTGTTTAAATTGCCAAACCCAGAGAGCAATATCAGGACAGCTT GGAGACATACGCAAAATGCCACCTGCACCATCAGGACCCAAAGCATCTC CTATGCCTGTTCCTACAGAATCATCATCTCAGAAAACAGCAGTGCCTCCC CAAGTAAAATTAGTGAAAAAGCAAGAACAAGAAGTAAAAACGGAAGCT GAAAAAGTCATTCTGGAAAAAGTAAAGGAAACACTATCAATGGAAAAAA TTCCTCCTATGGTAACCACAGATCAAAAACAAGAAGAGAGTAAACTAGA GAAAGACAAAGCTTCAGCTCTTCAAGAAAAAAAGCCACTCCCTGAAGAA AAAAAACTAATCCCTGAAGAAGAAAAGATACGTTCTGAAGAAAAAAAGC CACTCCTAGAAGAAAAAAAGCCAACCCCTGAAGACAAAAAGCTACTCCC AGAGGCAAAAACATCAGCCCCAGAAGAACAGAAACATGACTTACTTAAA TCTCAAGTACAAATTGCTGAAGAAAAGCTTGAAGGCAGAGTGGCTCCAA AGACAGTGCAAGAGGGAAACAACCACAGACCAAGATGGAAGGTTTACC ATCTGGCACACCTCAGAGTTTACCTAAAGAAGATGATAAGACAACCAAA ACAATAAAAGAACAGCCACAGCCACCATGCACAGCAAAACCTGATCAGG TGGAACCTGGGAAGAAAAAACAGAAAAGGAAGATGACAAATCAGACA CCTCAAGTTCTCAGCAGCCTAAAAGCCCCCAGGTCTGAGCGACACGGG ATATTCTTCCGATGGAATATCAAGCTCACTTGGTGAAATTCCAAGTCTTAT TCCAACTGATGAAAAGGATATTCTCAAGGGACTCAAAAAGGACTCTTTTT | SEQ ID NO: 78 |

TABLE B-continued

| Gene Fusion | Chimera Sequence | SEQ ID NO. |
|---|---|---|
| | CACAAGAAAGCAGCCCTTCCAGCCCCTCAGATTTGGCTAAGTTAGAAAGT<br>ACAGTCCTATCTATTTTGGAAGCTCAAGCAAGTACACTTGCTGATGAAAA<br>GTCAGAAAAGAAAACACAACCCCATGAAGTTTCTCCTGAACAGCCTAAA<br>GACCAAGAGAAAACTCAGAGTTTATCTGAAACCTTGGAAATTACTATTTC<br>AGAAGAGGAGATCAAAGAGAGTCAAGAAGAAAGGAAAGACACTTTTAA<br>AAAAGATAGCCAACAAGATATTCCTTCCAGCAAGGACCATAAAGAGAAG<br>TCTGAGTTTGTTGATGACATAACTACTAGAAGAGAGCCTTATGATTCAGT<br>TGAAGAGAGTAGTGAAAGTGAAAACTCACCTGTTCCACAAAGAAAACGA<br>AGAACTAGTGTTGGCTCATCAAGCAGTGATGAGTATAAACAGGAAGACA<br>GCCAAGGATCAGGGGAAGAGGAGGACTTCATTCGAAAACAAATCATAGA<br>AATGAGTGCTGATGAAGATGCTTCAGGTTCTGAAGATGATGAGTTCATCA<br>GAAACCAGCTCAAAGAGATTAGTAGCAGTACTGAGAGCCAGAAGAAGGA<br>AGAAACAAAGGGAAAAGGCAAAATAACAGCAGGGAAACACAGACGACT<br>GACTCGAAAAAGTAGCACAAGCATTGATGAAGATGCAGGAAGACGTCAC<br>TCATGGCATGATGAAGACGATGAAGCATTTGATGAAAGTCCTGAACTTAA<br>ATACAGAGAAACTAAAAGTCAGGAAAGTGAAGAACTTGTAGTTACTGGA<br>GGAGGAGGGCTACGCCGATTTAAAACAATTGAGCTCAACAGTACAATAG<br>CAGATAAATATTCTGCAGAGTCATCACAGAAAAAAACAAGTTTGTATTTT<br>GACGAAGAGCCAGAATTGGAAATGGAAAGCCTGACAGACTCACCTGAAG<br>ATAGGTCAAGGGGAGAGGGATCTTCGAGTCTGCATGCTTCCAGCTTCACT<br>CCTGGTACATCCCCTACATCAGTATCATCACTTGATGAGGACAGTGACAG<br>TAGCCCGAGTCACAAAAAAGGAGAGAGCAAACAGCAACGCAAAGCTCG<br>GCACAGACCACATGGCCCTCTTTTGCCTACTATTGAAGATTCTTCAGAGG<br>AAGAAGAATTGAGAGAGGAAGAAGAATTATTAAAGGAGCAAGAAAAGC<br>AGAGGGAAATAGAACAGCAACAAAGAAAGAGTTCTAGTAAAAAATCAA<br>AGAAAGACAAAGATGAACTTCGAGCTCAGAGAAGAAGGGAAAGGCCAA<br>AGACACCACCTAGTAATCTCTCTCCCATTGAAGATGCATCTCCGACAGAA<br>GAGTTACGTCAGGCTGCAGAAATGGAGGAGCTCCATAGATCTTCTTGTTC<br>TGAATATTCACCTAGCATAGAGTCAGACCCAGAAGGTTTTGAAATAAGCC<br>CGGAAAAAATAATAGAAGTACAAAAAGTTTATAAATTGCCCACAGCTGT<br>TTCATTATACTCACCAACAGATGAGCAATCTATTATGCAGAAAGAAGGTA<br>GCCAAAAGGCGTTAAAAAGTGCTGAGGAGATGTATGAAGAAATGATGCA<br>TAAAACACACAAATACAAAGCTTTTCCAGCTGCAAATGAACGAGATGAA<br>GTGTTTGAAAAAGAGCCTTTGTATGGTGGGATGCTAATAGAGGATTATAT<br>TTATGAATCTTTAGTAGAAGACACGTACAATGGATCGGTAGATGGCAGTC<br>TGCTAACAAGGCAAGAAGAAGAAAATGGATTTATGCAGCAGAAAGGAAG<br>AGAGCAAAAGATAAGACTTTCAGAACAGATTTATGAAGATCCTATGCAG<br>AAAATTACAGACCTCCAGAAAGAGTTTTATGAGTTAGAAAGCTTACATTC<br>TGTTGTGCCTCAGGAAGATATTGTTTCAAGCTCTTTTATCATCCCAGAAAG<br>CCATGAGATAGTGGACCTGGGTACTATGGTAACTTCTACAGAAGAAGAA<br>AGGAAACTACTAGATGCTGATGCTGCCTATGAAGAACTTATGAAGAGGC<br>AACAGATGCAATTAACACCTGGATCTAGCCCAACCCAGGCCCCCATTGGT<br>GAGGATATGACAGAGTCCACCATGGACTTTGACAGAATGCCAGATGCCTC<br>TTTGACATCAAGTGTTCTCTCAGGAGCGTCTCTTACAGATTCGACCAGCA<br>GTGCAACACTCTCTATCCCAGATGTTAAAATAACCCAACATTTTTCAACA<br>GAAGAAATTGAGGATGAATATGTAACCGATTATACAAGAGAAATTCAAG<br>AGATAATTGCCCATGAATCGCTGATTTTGACCTACTCGGAGCCTTCAGAA<br>AGTGCTACATCTGTCCCACCCTCTGACACACCTTCTCTCACATCATCTGTT<br>TCTTCGGTCTGTACCACAGATAGCTCTTCACCCATTACTACCCTGGATAGC<br>ATAACCACAGTTTATACAGAGCCAGTGGACATGATAACTAAATTTGAAGA<br>TTCTGAGGAAATTTCTTCATCAACTTATTTTCCAGGCAGCATTATAGACTA<br>TCCAGAAGAAATAAGTGTATCTTTAGATCGGACTGCCCCACCAGATGGTA<br>GAGCTAGTGCTGATCATATTGTTATTTCCTTATCTGATATGGCATCTTCTA<br>TCATAGAATCTGTAGTACCTAAACCTGAAGGGCCAGTTGCTGACACTGTT<br>TCTACTGACTTACTTTATATCTGAAAAGGACCCAGTGAAGAAAGCCAAGAA<br>GGAAACTGGGAATGGAATCATTCTGGAAGTTTTGGAAGCTTACAGAGAT<br>AAAAAGGAGTTGGAGGCCGAACGAACAAAAAGTAGCTTATCCGAAACCG<br>TGTTTGATCACCCACCTTCTTCTGTAATAGCCCTTCCAATGAAAGAGCAGC<br>TTTCAACTACATACTTTACATCTGGAGAGACCCTTTGGTCAGGAAAAACCT<br>GCATCTCAGTTACCATCTGGCAGTCCTTCTGTTTCCTCTCTTCCAGCTAAA<br>CCTCGCCCATTCTTTAGAAGTTCTTCTTTGGATATATCAGCTCAACCTCCT<br>CCCCCTCCTCCCCCTCCCCCTCCTCCTCCTCCACCACCACCCCCTCCTC<br>CCCCACCACTTCCTCCACCAACTTCACCTAAACCAACTATTCTTCCTAAAA<br>AAAAGTTAACAGTTGCATCTCCAGTGACTACAGCTACACCTCTGTTTGAT<br>GCTGTTACTACTCTAGAGACCACAGCTGTTCTGAGAAGTAATGGATTACC<br>TGTTACAAGAATATGTACTACTGCACCTCCTCCTGTTCCTCCTAAGCCATC<br>TTCAATTCCATCTGGACTTGTATTTACCCACAGGCCTGAGCCAAGCAAAC<br>CTCCAATCGCCCCCAAACCAGTGATTCCTCAGCTTCCAACAACTACACAA<br>AAACCAACAGATATACACCCCAAACCAACAGGCCTATCTTTAACTTCAAG<br>TATGACCTTAAATTTAGTGACTTCAGCAGATTATAAATTGCCTTCCCCTAC<br>CTCCCCACTTTCCCCACACTCCAACAAGTCTTCACCAAGATTTTCCAAATC<br>CCTCACAGAAACTTATGTAGTTATTACATTGCCATCTGAACCAGGGACTC<br>CAACAGATTCTTCTGCTAGTCAAGCAATTACCAGTTGGCCCTTGGGATCA<br>CCCTCCAAAGATCTGGTTTCTGTTGAACCTGTGTTTTCTGTAGTTCCTCCT<br>GTGACAGCTGTAGAAATTCCAATTTCTTCAGAACAGACCTTCTACATCTCT<br>GGAGCTTTACAGACATTTTCTGCTACCCCTGTCACAGCACCCTCTTCATTT<br>CAAGCAGCTCCCACATCAGTTACACAGTTTCTCACTACTGAAGTTTCCAA | |

TABLE B-continued

| Gene Fusion | Chimera Sequence | SEQ ID NO. |
|---|---|---|
| | GACTGAGGTTTCAGCAACCAGAAGTACAGCTCCTAGTGTTGGTCTCAGCA GCATTTCCATAACAATTCCTCCAGAGCCTCTTGCTCTAGATAACATACATT TAGAGAAGCCTCAGTATAAAGAAGATGGAAAATTGCAACTTGTTGGTGA TGTAATTGATTTGCGTACAGTACCAAAGGTAGAAGTTAAAACAACTGATA AATGTATTGATCTTTCTGCTTCTACAATGGATGTGAAAAGGCAGATCACA GCAAATGAAGTTTATGGGAAACAAATTAGTGCTGTCCAACCCTCTATTAT AAATCTTAGTGTGACATCATCAATAGTGACTCCTGTATCTCTGGCCACTG AGACAGTGACCTTTGTCACATGCACAGCTAGTGCAAGTTACACTACAGGC ACAGAAAGCCTAGTGGGTGCAGAACATGCAATGACAACACCACTCCAAC TTACAACATCAAAGCATGCTGAGCCCCCATACAGGATACCAAGTGACCA GGTCTTTCCTATAGCTAGGGAAGAAGCACCAATAAACTTATCTCTAGGTA CTCCAGCACATGCAGTGACATTGGCTATTACAAAACCTGTCACTGTGCCT CCTGTTGGTGTCACAAATGGATGGACTGATAGCACCGTATCCCAGGGAAT CACTGATGGGAAGTAGTGGATCTCAGTACAACCAAGTCTCACAGAACA GTCGTAACAATGGATGAGTCTACTTCAAGTGTGATGACCAAAATAATAGA AGATGAAAAACCCGTTGATTTAACCGCAGGGAGAAGAGCTGTGTGCTGT GATGTGGTTTATAAATTACCATTTGGAAGGAGCTGCACAGCACAGCAGCC TGCAACTACTCTTCCTGAGGATCGTTTTGGTTATAGGGATGACCACTATCA GTATGATCGATCAGGGCCATATGGTTATAGAGGGATTGGGGGAATGAAG CCTTCCATGTCTGACACAAATTTAGCAGAAGCTGGACATTTTTTCTATAAA AGTAAGAATGCTTTTGATTATTCTGAAGGAACTGACACAGCAGTAGATCT GACTTCAGGGAGAGTTACTACAGGTGAGGTAATGGATTATTCAAGCAAG ACTACAGGTCCATATCCAGAAACACGACAAGTCATTTCAGGAGCTGGGAT TAGTACCCCACAGTATTCCACAGCAAGAATGACACCACCACCAGGACCCC AGTATTGTGTGGGGAGTGTTTTGAGGTCATCTAATGGTGTTGTCTATTCTT CAGTAGCAACTCCAACACCCTCTACATTTGCTATCACCACACAACCTGGC TCCATTTTCAGCACCACAGTGAGGGATTTGTCTGGTATTCATACGGCTGAT GCAGTGACTTCATTACCTGCCATGCACCATAGCCAGCCAATGCCTAGATC ATATTTTATAACAACAGGTGCATCTGAAACGGACATTGCAGTAACTGGTA TTGATATCAGTGCCAGTTTGCAAACTATTACTATGGAGTCTCTTACTGCTG AGACGATAGACTCTGTTCCCACTTTAACCACAGCATCCGAAGTGTTTCCT GAAGTGGTGGGAGATGAAAGTGCTCTTTTAATTGTCCCTGAAGAAGATAA ACAACAGCAGCAGCTAGACTTGGAGCGTGAGCTCCTGGAACTGGAGAAA ATTAAGCAACAGCGCTTTGCTGAGGAATTGGAGTGGGAACGTCAGGAAA TTCAAAGGTTCCGAGAACAAGAAAAGATCATGGTTCAGAAAAAGTTGGA GGAGCTGCAGTCTATGAAGCAACACCTTCTCTTTCAGCAAGAAGAAGAGC GGCAAGCCCAGTTCATGATGAGGCAGGAGACGTTAGCTCAGCAACAGTT ACAGCTTGAGCAGATCCAACAGCTGCAACAACAGCTTCACCAGCAGCTG GAGGAGCAAAAGATTCGGCAGATCTACCAGTATAACTATGACCCTTCTGG AACTGCTTCTCCACAAACCACTACAGAGCAGGCAATTTTGGAAGGTCAGT ATGCTGCTCTGGAAGGCAGTCAATTTTGGGCAACTGAAGATGCAACCACC ACAGCTTCAGCTGTTGTGGCAATTGAAATACCACAAAGCCAAGGATGGTA CACCGTTCAGTCTGATGGTGTTACTCAGTACATTGCCCCACCTGGTATCCT GAGCACTGTTTCAGAAATACCTCTAACAGATGTTGTTGTGAAAGAGGAAA AACAACCCAAAAGAGAAGTTCTGGAGCTAAAGTCCGAGGACAGTATGA TGACATGGGAGAAAATATGACAGATGATCCCCGAAGTTTTAAAAAGATA GTGGACAGTGGTGTACAAACGGATGACGAAGATGCCACAGATCGGAGCT ATGTGAGTAGGAGAAGGAGAACTAAAAAGAGTGTGGATACAAGCGTCCA AACTGATGATGAAGATCAGGATGAGTGGGATATGCCTACTAGATCAAGG AGGAAAGCTCGTGTAGGGAAATATGGTGACAGCATGACAGAGGCTGACA AGACCAAACCCCTTTCCAAAGTCTCCAGCATAGCAGTTCAAACGGTAGCA GAGATATCTGTGCAAACTGAACCAGTTGGAACCATAAGAACACCCTCCAT ACGGGCACGAGTGGATGCCAAGGTAGAAATAATTAAACACATTTCAGCA CCTGAAAAGACTTACAAAGGGGGCAGTTTAGGATGTCAAACAGAAGCAG ATTCAGACACACAAAGTCCTCAATATCTGAGTGCCACATCTCCACCCAAA GACAAGAAACGCCCAACACCCTTTAGAGATTGGTTATTCATCTCACCTCCG GGCAGATTCCACAGTACAGCTGGCTCCTTCCCCACCCAAATCCCCCAAAG TCCTTTACTCACCCCATCTCACCACTTTCACCAGGCAAAGCCTTAGAATCAG CCTTTGTACCTTATGAAAAACCCCTCCCTGATGATATAAGTCCACAGAAA GTACTGCATCCAGATATGGCTAAAGTTCCCCCAGCAAGTCCTAAGACAGC CAAGATGATGCAGCGTTCTATGTCTGACCCCAAGCCTCTGAGTCCAACAG CAGACGAAAGTTCCAGGGCTCCTTTTCAGTATACCGAGGGCTATACGACT AAAGGTTCTCAAACCATGACATCCTCTGGAGCCCAGAAAAAAGTTAAAA GAACTCTGCCAAATCCACCTCCTGAGGAGATTTCCACAGGAACTCAATCC ACATTCAGCACAATGGGCACAGTTTCCAGGAGAAGGATCTGCAGAACCA ACACAATGGCACGAGCCAAGATTCTCCAGGACATAGACAGAGAGCTTGA TCTTGTGGAAAGGGAGTCTGCAAAACTTCGAAAGAAACAAGCAGAGCTT GATGAAGAAGAAAAGGAGATTGATGCTAAGCTACGATACCTGGAAATGG GAATTAACAGGAGGAAAGAGGCCCTATTAAAGGAGAGAAAAGAGAG AACGAGCCTACCTCCAGGGAGTAGCTGAGGATCGTGATTACATGTCTGAC AGTGAAGTGAGTAGCACAAGACCAACCCGAATAGAAAGTCAGCATGGCA TTGAGCGACCAAGAACTGCTCCCAAACTGAATTCAGCCAGTTTATACCA CCACAAACCCAAACAGAATCTCAACTAGTTCCTCCGACAAGTCCTTACAC ACAATACCAGTACTCTTCCCCTGCTCTTCCTACCCAAGCACCCACCTCATA CACTCAACAGTCTCATTTTGAGCAACAAACTTTGTACCATCAGCAAGTTT CACCTTATCAGACTCAGCAACATTCCAAGCTGTGGCAACAATGTCCTTC ACACCTCAAGTTCAACCTACACCAACCCCACAGCCTTCTTATCAGTTACCT | |

TABLE B-continued

| Gene Fusion | Chimera Sequence | SEQ ID NO. |
|---|---|---|
| | TCACAGATGATGGTGATACAACAGAAGCCACGGCAAACTACATTATATTT<br>GGAGCCCAAGATAACCTCAAACTATGAAGTGATTCGCAACCAACCCCTTA<br>TGATAGCACCTGTTTCTACGGATAACACATTTGCTGTTTCCCATCTTGGTA<br>GTAAGTACAATAGTTTAGACTTGAGAATAGGTTTGGAGGAAAGAAGTAG<br>CATGGCAAGCAGTCCAATATCAAGCATATCTGCAGATTCTTTCTATGCAG<br>ATATTGATCACCATACTCCACGAAATTATGTCCTAATTGACGACATTGGA<br>GAGATCACCAAAGGAACAGCGGCATTAAGCACCGCATTTAGCCTTCATG<br>AAAAGGATCTGTCAAAACAGACCGTCTCCTTCGAACCACTGAGACACG<br>CCGGTCTCAAGAAGTGACAGATTTCCTAGCACCTTTACAGTCTTCCTCTAG<br>ATTGCATAGTTATGTGAAGGCGGAGGAAGACCCAATGGAGGATCCTTAC<br>GAGTTAAAGCTTCTGAAACATCAGATTAAACAGGAATTTCGTAGAGGGA<br>CAGAGAGCTTAGATCACCTTGCTGGTCTTTCTCATTATTACCATGCTGATA<br>CTAGCTACAGACATTTTCCAAAATCTGAGAAGTATAGCATCAGTAGACTC<br>ACACTTGAAAACAAGCAGCAAAACAACTGCCAGCAGCCATACTTTATC<br>AAAAGCAGTCAAAGCATAAGAAATCACTAATTGACCCTAAAATGTCAAA<br>ATTTTCACCTATTCAAGAAAGTAGAGACCTTGAACCTGATTATTCAAGCT<br>ATATGACTTCTAGCACTTCATCTATTGGTGGCATTTCCTCCAGGGCAAGGC<br>TCCTTCAAGATGACATCACTTTTGGCCTCAGAAAAAATATTACAGACCAA<br>CAAAAATTTATGGGATCTTCTCTTGGCACAGGACTGGGCACATTAGGAAA<br>TACCATACGCTCAGCTCTGCAGGATGAAGCGGATAAGCCATACAGTAGTG<br>GCAGCAGGTCCAGACCTTCCTCCAGACCTTCCTCTGTCTATGGGCTTGATT<br>TATCAATTAAAAGGGATTCTTCTAGCTCTTCCCTAAGACTGAAAGCTCAA<br>GAGGCTGAAGCTAGATGTTTCCTTTAGTCATGCATCATCCTCTGCCAGA<br>ACTAAGCCGACCAGTTTGCCAATTAGTCAAAGTAGAGGAAGAATACCAA<br>TTGTGGCCCAGAATTCTGAAGAAGAAAGCCCACTCAGTCCTGTTGGCCAG<br>CCAATGGGAATGGCCAGGGCTGCAGCTGGACCCCTGCCACCAATATCTGC<br>AGACACCAGGGATCAGTTTGGATCAAGCCACTCATTGCCTGAAGTTCAGC<br>AACACATGAGGGAAGAATCACGGACTCGAGGCTATGACCGTGACATAGC<br>ATTCATCATGGATGACTTCCAACATGCCATGTCAGACAGTGAAGCCTATC<br>ATCTGCGTCGTGAGGAAACAGATTGGTTTGATAAACCCAGGGAGTCTCGT<br>TTGGAAAATGGACATGGTCTGGACCGAAAACTGCCGGAAAGATTGGTCC<br>ACTCTAGACCACTCAGTCAACATCAAGAGCAAATTATACAGATGAACGG<br>GAAAACTATGCACTACATCTTTCCTCACGCAAGGATAAAAATAACAAGA<br>GACTCAAAGGATCACACAGTTTCAGGTAATGGATTAGGAATTAGAATTGT<br>GGGTGGTAAAGAAATCCCGGGACATAGTGGAGAAATTGGAGCCTATATT<br>GCCAAGATTCTTCCTGGGGGAAGTGCGGAACAGACGGGGAAGCTTATGG<br>AAGGGATGCAAGTATTGGAATGGAATGGAATTCCCTTGACTTCTAAAACA<br>TATGAAGAAGTTCAGAGTATCATTAGTCAGCAAAGTGGGGAAGCAGAAA<br>TATGTGTAAGACTGGACCTCAATATGCTATCAGATTCTGAAAATTCCCAG<br>CATCTGGAACTTCATGAGCCACCAAAAGCTGTGGATAAGGCGAAATCCCC<br>AGGGGGTTGATCCTAAGCAGTTGGCAGCAGAACTCCAGAAGGTTTCACTAC<br>AGCAGTCACCGCTGGTTCTGTCATCAGTTGTTGAAAAAGGATCTCATGTT<br>CATTCAGGTCCTACATCAGCAGGATCCAGTTCCGTTCCCAGCCCTGGGCA<br>ACCAGGGTCCCCCTCAGTGAGCAAAAGAAGCACGGCAGCAGCAAGCCT<br>ACCGATGGAACAAAGGTTGTCTCTCATCCAATTACAGGAGAAATTCAGCT<br>TCAAATTAACTATGATCTTGGAAATCTCATAATACATATTCTCCAAGCAA<br>GAAATCTTGTTCCTCGAGACAACAATGGTTATTCTGACCCTTTTGTGAAA<br>GTGTACCTTCTTCCAGGGAGAGGTCAAGTCATGGTTGTCCAGAATGCAAG<br>TGCTGAGTACAAGAGAAGGACTAAACATGTCCAGAAAAGTCTTAATCCT<br>GAGTGGAATCAAACAGTAATTTATAAAAGTATTTCCATGGAACAGCTCAA<br>GAAGAAAACACTGGAGGTGACAGTTTGGGATTATGATAGATTTTCATCCA<br>ACGACTTCCTTGGGGAGGTATTGATTGATTTATCTAGCACATCTCACCTCG<br>ATAACACTCCAAGGTGGTATCCTCTCAAAGAACAGACTGAAAGCATTGAT<br>CATGGCAAGTCTCATTCCAGTCAGAGCAGCCAGCAGTCCCCAAAGCCATC<br>TGTTATCAAAAGCAGAAGCCATGGTATCTTCCCTGACCCATCAAAGGACA<br>TGCAGGTTCCCACCATTGAGAAATCCCATAGTAGTCCTGGTAGCTCAAAA<br>TCATCATCAGAAGGCATCTCCGTTCTCATGGACCATCTCGCAGTCAAAG<br>CAAAACCAGCGTCACTCAGACCCACCTGGAAGATGCAGGGGCTGCCATA<br>GCTGCTGCCGAAGCTGCCGTGCAACAACTCCGCATTCAACCAAGTAAAAG<br>ACGCAAATAA | |
| SNX9-><br>RAB2A | ATGGCCACCAAGGCATTTATTAATACAGCAAAAGAAATTTATGAAAAAA<br>TTCAAGAAGGAGTCTTTGACATTAATAATGAGGCAAATGGCATTAAAATT<br>GGGCCCTCAGCATGCTGCTACCAATGCAACACATGCAGGCAATCAGGGAG<br>GACAGCAGGCTGGGGCGGCTGCTGTTGA | SEQ ID NO: 79 |
| DNMBP-><br>TACC2 | CAGGGGCGGAGGTGACAGCGGGCTGGGGACTGGCGGCTGCAACTGCCTG<br>CCGCGCCGAGGGACCGCCGGGCGGCGGAAAGCAGGAGTTCCGATTCTGA<br>AGAGGCATTTGAGACCCCGGAGTCAACGACCCCTGTCAAAGCTCCGCCA<br>GCTCCACCCCCACCACCCCCCGAAGTCATCCCAGAACCCGAGGTCAGCAC<br>ACAGCCACCCCCGGAAGAACCAGGATGTGGTTCTGAGACAGTCCCTGTCC<br>CTGATGGCCCACGGAGCGACTCGGTGGAAGGAAGTCCCTTCCGTCCCCCG<br>TCACACTCCTTCTCTGCCGTCTTCGATGAAGACAAGCCGATAGCCAGCAG<br>TGGGACTTACAACTTGGACTTTGACAACATTGAGCTTGTGGATACCTTTC<br>AGACCTTGGAGCCTCGTGCCTCAGACGCTAAGAATCAGGAGGGCAAAGT<br>GAACACACGGAGGAAGTCCACGGATTCCGTCCCATCTCTAAGTCTACAC<br>TGTCCCGGTCGCTCAGCCTGCAAGCCAGTGACTTTGATGGTGCTTCTTCCT | SEQ ID NO: 80 |

TABLE B-continued

| Gene Fusion | Chimera Sequence | SEQ ID NO. |
|---|---|---|
| | CAGGCAATCCCGAGGCCGTGGCCCTTGCCCCAGATGCATATAGCACGGGT<br>TCCAGCAGTGCTTCTAGTACCCTTAAGCGAACTAAAAAACCGAGGCCGCC<br>TTCCTTAAAAAAGAAACAGACCACCAAGAAACCCACAGAGACCCCCCCA<br>GTGAAGGAGACGCAACAGGAGCCAGATGAAGAGAGCCTTGTCCCCAGTG<br>GGGAGAATCTAGCATCTGAGACGAAAACGGAATCTGCCAAGACGGAAGG<br>TCCTAGCCCAGCCTTATTGGAGGAGACGCCCCTTGAGCCCGCTGTGGGGC<br>CCAAAGCTGCCTGCCCTCTGGACTCAGAGAGTGCAGAAGGGGTTGTCCCC<br>CCGGCTTCTGGAGGTGGCAGAGTGCAGAACTCACCCCCTGTCGGGAGGA<br>AAACGCTGCCTCTTACCACGGCCCCGGAGGCAGGGGAGGTAACCCCATC<br>GGATAGCGGGGGGCAAGAGGACTCTCCAGCCAAAGGGCTCTCCGTAAGG<br>CTGGAGTTTGACTATTCTGAGGACAAGAGTAGTTGGGACAACCAGCAGG<br>AAAACCCCCCTCCTACCAAAAGATAGGCAAAAAGCCAGTTGCCAAAAT<br>GCCCCTGAGGAGGCCAAAGATGAAAAAGACACCCGAGAAACTTGACAAC<br>ACTCCTGCCTCACCTCCCAGATCCCCTGCTGAACCCAATGACATCCCCATT<br>GCTAAAGGTACTTACACCTTTGATATTGACAAGTGGGATGACCCCAATTT<br>TAACCCTTTTTCTTCCACCTCAAAAATGCAGGAGTCTCCCAAACTGCCCCA<br>ACAATCATACAACTTTGACCCAGACACCTGTGATGAGTCCGTTGACCCCT<br>TTAAGACATCCTAAGACCCCCAGCTCACCTTCTAAATCCCCAGCCTCCT<br>TTGAGATCCCAGCCAGTGCTATGGAAGCCAATGGAGTGGACGGGGATGG<br>GCTAAACAAGCCCGCCAAGAAGAAGAAGACGCCCCTAAAGACTGACACA<br>TTTAGGGTGAAAAAGTCGCCAAAACGGTCTCCTCTCTCTGATCCACCTTC<br>CCAGGACCCCACCCCAGCTGCTACACCAGAAACACCACCAGTGATCTCTG<br>CGGTGGTCCACGCCACAGATGAGGAAAAGCTGGCGGTCACCAACCAGAA<br>GTGGACGTGCATGACAGTGGACCTAGAGGCTGACAAACAGGACTACCCG<br>CAGCCCTCGGACCTGTCCACCTTTGTAAACGAGACCAAATTCAGTTCACC<br>CACTGAGGAGTTGGATTACAGAAACTCCTATGAAATTGAATATATGGAGA<br>AAATTGGCTCCTCCTTACCTCAGGACGACGATGCCCCGAAGAAGCAGGCC<br>TTGTACCTTATGTTTGACACTTCTCAGGAGAGCCCTGTCAAGTCATCTCCC<br>GTCCGCATGTCAGAGTCCCCGACGCCGTGTTCAGGGTCAAGTTTTGAAGA<br>GACTGAAGCCCTTGTGAACACTGCTGCGAAAAACCAGCATCCTGTCCCAC<br>GAGGACTGGCCCCTAACCAAGAGTCACACTTGCAGGTGCCAGAGAAATC<br>CTCCCAGAAGGAGCTGGAGGCCATGGGCTTGGGCACCCCTTCAGAAGCG<br>ATTGAAATTACAGCTCCCGAGGGCTCCTTTGCCTCTGCTGACGCCCTCCTC<br>AGCAGGCTAGCTCACCCCGTCTCTCTCTGTGGTGCACTTGACTATCTGGA<br>GCCCGACTTAGCAGAAAAGAACCCCCCACTATTCGCTCAGAAACTCCAGG<br>AGGAGTTAGAGTTTGCCATCATGCGGATAGAAGCCCTGAAGCTGGCCAG<br>GCAGATTGCTTTGGCTTCCCGCAGCCACCAGGATGCCAAGAGAGAGGCTG<br>CTCACCCAACAGAGTCTCCATCTCCAAAACAGCCTTGTACTCCCGCATC<br>GGGACCGCTGAGGTGGAGAAACCTGCAGGCCTTCTGTTCCAGCAGCCCG<br>ACCTGGACTCTGCCCTCCAGATCGCCAGAGCAGAGATCATAACCAAGGA<br>GAGAGAGGTCTCAGAATGGAAAGATAAATATGAAGAAAGCAGGCGGGA<br>AGTGATGGAAATGAGGAAAATAGTGGCCGAGTATGAGAAGACCATCGCT<br>CAGATGATAGAGGACGAACAGAGAGAGAAGTCAGTCTCCCACCAGACGG<br>TGCAGCAGCTGGTTCTGGAGAAGGAGCAAGCCCTGGCCGACCTGAACTC<br>CGTGGAGAAGTCTCTGGCCGACCTCTTCAGAAGATATGAGAAGATGAAG<br>GAGGTCCTAGAAGGCTTCCGCAAGAATGAAGAGGTGTTGAAGAGATGTG<br>CGCAGGAGTACCTGTCCCGGGTGAAGAAGGAGGAGCAGAGGTACCAGGC<br>CCTGAAGGTGCACGCGGAGGAGAAACTGGACAGGGCCAATGCTGAGATT<br>GCTCAGGTTCGAGGCAAGGCCCAGCAGGAGCAAGCCGCCCACCAGGCCA<br>GCCTGCGGAAGGAGCAGCTGCGAGTGGACGCCCTGGAAAGGACGCTGGA<br>GCAGAAGAATAAAGAAATAGAAGAACTCACCAAGATTTGTGACGAACTG<br>ATTGCCAAAATGGGGAAAAGCTAACTCTGAACCGAATGTTTTGGACTTAA<br>CTGTTGCGTGCAATATGACCGTCGGCACACTGCTGTTCCTCCAGTTCCATG<br>GACAGGTTCTGTTTTCACTTTTTCGTATGCACTACTGTATTCCTTTCTAAA<br>TAAAAATTGATTTGATTGTATGCAGTACTAAGGAGACTATCAGAATTTCTT<br>GCTATTGGTTTGCATTTTCCTAGTATAATTCATAGCAAGTTGACCTCAGAG<br>TTCCTGTATCAGGGAGATTGTCTGATTCTCTAATAAAAGACACATTGCTG<br>ACCTTGGCCTTGCCCTTTGTACACAAGTTCCCAGGGTGAGCAGCTTTTGG<br>ATTTAATATGAACATGTACAGCGTGCATAGGGACTCTTGCCTTAAGGAGT<br>GTAAACTTGATCTGCATTTGCTGATTTGTTTTTAAAAAAACAAGAAATGC<br>ATGTTTCAAATAAAATTCTCTATTGTAAATAAAATTTTTTCTTTGGATCTT<br>GGCAAT | |
| RREB1-><br>DSP | CGGGATGGCAACTGCGGTCACCCTGCTAAAGTCGGGGCGGGGCGGCGG<br>TCCTCCCCCTCACCCCCCCAGTCCGAGCGCCGCCGCCGCCGCCGCCGCC<br>GCCGCCGCGGCCGCTCAGTAACACGTCCCCAGGAGACTCGCAGGAGCAA<br>CACGTGATGTGTCTACTTATCAGGTCAAACCGGCACGATGTCCAGGCACC<br>AGAACCAGAACACCATCCAGGAGCTGCTGCAGAACTGCTCCGACTGCTTG<br>ATGCGAGCAGAGCTCATCGTGCAGCCTGAATTGAAGTATGGAGATGGAA<br>TACAACTGACTCGGAGTCGAGAATTGGATGAGTGTTTTGCCCAGGCCAAT<br>GACCAAATGGAAATCCTCGACAGCTTGATCAGAGAGATGCGGCAGATGG<br>GCCAGCCCTGTGATGCTTACCAGAAAAGGCTTCTTCAGCTCCAAGAGCAA<br>ATGCGAGCCCTTTATAAAGCCATCAGTGTCCCTCGAGTCCGCAGGGCCAG<br>CTCCAAGGGTGGTGGAGGCTACACTTGTCAGAGTGGCTCTGCTGGGATG<br>AGTTCACCAAACATGTCACCAGTGAATGTTTGGGGTGGATGAGGCAGCA<br>AAGGGCGGAGATGGACATGGTGGCCTGGGGTGTGGAACCTGGCCTCAGTG<br>GAGCAGCACATTAACAGCCACCGGGGCATCCACAACTCCATCGGCGACT | SEQ ID NO: 81 |

TABLE B-continued

| Gene Fusion | Chimera Sequence | SEQ ID NO. |
|---|---|---|
| | ATCGCTGGCAGCTGGACAAAATCAAAGCCGACCTGCGCGAGAAATCTGC<br>TATCTACCAGTTGGAGGAGGAGTATGAAAACCTGCTGAAAGCGTCCTTTG<br>AGAGGATGGATCACCTGCGACAGCTGCAGAACATCATTCAGGCCACGTC<br>CAGGGAGATCATGTGGATCAATGACTGCGAGGAGGAGGAGCTGCTGTAC<br>GACTGGAGCGACAAGAACACCAACATCGCTCAGAAACAGGAGGCCTTCT<br>CCATACGCATGAGTCAACTGGAAGTTAAAGAAAAAGAGCTCAATAAGCT<br>GAAACAAGAAAGTGACCAACTTGTCCTCAATCAGCATCCAGCTTCAGACA<br>AAATTGAGGCCTATATGGACACTCTGCAGACGCAGTGGAGTTGGATTCTT<br>CAGATCACCAAGTGCATTGATGTTCATCTGAAAGAAAATGCTGCCTACTT<br>TCAGTTTTTTGAAGAGGCGCAGTCTACTGAAGCATACCTGAAGGGGCTCC<br>AGGACTCCATCAGGAAGAAGTACCCCTGCGACAAGAACATGCCCCTGCA<br>GCACCTGCTGGAACAGATCAAGGAGCTGGAGAAAGAACGAGAGAAAATC<br>CTTGAATACAAGCGTCAGGTGCAGAACTTGGTAAACAAGTCTAAGAAGA<br>TTGTACAGCTGAAGCCTCGTAACCCAGACTACAGAAGCAATAAACCCATT<br>ATTCTCAGAGCTCTCTGTGACTACAAACAAGATCAGAAAATCGTGCATAA<br>GGGGGATGAGTGTATCCTGAAGGACAACAACGAGCGCAGCAAGTGGTAC<br>GTGACGGGCCCGGGAGGCGTTGACATGCTTGTTCCCTCTGTGGGCTGAT<br>CATCCCTCCTCCGAACCCACTGGCCGTGGACCTCTCTTGCAAGATTGAGC<br>AGTACTACGAAGCCATCTTGGCTCTGTGGAACCAGCTCTACATCAACATG<br>AAGAGCCTGGTGTCCTGGCACTACTGCATGATTGACATAGAGAAGATCAG<br>GGCCATGACAATCGCCAAGCTGAAAACAATGCGGCAGGAAGATTACATG<br>AAGACGATAGCCGACCTTGAGTTACATTACCAAGAGTTCATCAGAAATAG<br>CCAAGGCTCAGAGATGTTTGGAGATGATGACAAGCGGAAAATACAGTCT<br>CAGTTCACCGATGCCCAGAAGCATTACCAGACCCTGGTCATTCAGCTCCC<br>TGGCTATCCCCAGCACCAGACAGTGACCACAACTGAAATCACTCATCATG<br>GAACCTGCCAAGATGTCAACCATAATAAAGTAATTGAAACCAACAGAGA<br>AAATGACAAGCAAGAAACATGGATGCTGATGGAGCTGCAGAAGATTCGC<br>AGGCAGATAGAGCACTGCGAGGGCAGGATGACTCTCAAAAACCTCCCTC<br>TAGCAGACCAGGGATCTTCTCACCACATCACAGTGAAAATTAACGAGCTT<br>AAGAGTGTGCAGAATGATTCACAAGCAATTGCTGAGGTTCTCAACCAGCT<br>TAAAGATATGCTTGCCAACTTCAGAGGTTCTGAAAAGTACTGCTATTTAC<br>AGAATGAAGTATTTGGACTATTTCAGAAACTGGAAAATATCAATGGTGTT<br>ACAGATGGCTACTTAAATAGCTTATGCACAGTAAGGGCACTGCTCCAGGC<br>TATTCTCCAAACAGAAGACATGTTAAAGGTTTATGAAGCCAGGCTCACTG<br>AGGAGGAAACTGTCTGCCTGGACCTGGATAAAGTGGAAGCTTACCGCTGT<br>GGACTGAAGAAAATAAAAAATGACTTGAACTTGAAGAAGTCGTTGTTGG<br>CCACTATGAAGACAGAACTACAGAAAGCCCAGCAGATCCACTCTCAGAC<br>TTCACAGCAGTATCCACTTTATGATCTGGACTTGGGCAAGTTCGGTGAAA<br>AAGTCACACAGCTGACAGACCGCTGGCAAAGGATAAAACAGATCGA<br>CTTTAGGTTATGGGACCTGGAGAAACAAATCAAGCAATTGAGGAATTATC<br>GTGATAACTATCAGGCTTTCTGCAAGTGGCTCTATGATGCTAAACGCCGC<br>CAGGATTCCTTAGAATCCATGAAATTTGGAGATTCCAACACAGTCATGCG<br>GTTTTTGAATGAGCAGAAGAACTTGCACAGTGAAATATCTGGCAAACGA<br>GACAAATCAGAGGAAGTACAAAAAATTGCTGAACTTTGCGCCAATTCAA<br>TTAAGGATTATGAGCTCCAGCTGGCCTCATACACCTCAGGACTGGAAACT<br>CTGCTGAACATACCTATCAAGAGGACCATGATTCAGTCCCCTTCTGGGGT<br>GATTCTGCAAGAGGCTGCAGATGTTCATGCTCGGTACATTGAACTACTTA<br>CAAGATCTGGAGACTATTACAGGTTCTTAAGTGAGATGCTGAAGAGTTTG<br>GAAGATCTGAAGCTGAAAAATACCAAGATCGAAGTTTTGGAAGAGGAGC<br>TCAGACTGGCCCGAGATGCCAACTCGGAAAACTGTAATAAGAACAAATT<br>CCTGGATCAGAACCTGCAGAAATACCAGGCAGAGTGTTCCCAGTTCAAA<br>GCGAAGCTTGCGAGCCTGGAGGAGCTGAAGAGACAGGCTGAGCTGGATG<br>GGAAGTCGGCTAAGCAAAATCTAGACAAGTGCTACGGCCAAATAAAAGA<br>ACTCAATGAGAAGATCACCCGACTGACTTATGAGATTGAAGATGAAAAG<br>AGAAGAAGAAAATCTGTGGAAGACAGATTTGACCAACAGAAGAATGACT<br>ATGACCAACTGCAGAAAGCAAGGCAATGTGAAAAGGAGAACCTTGGTTG<br>GCAGAAATTAGAGTCTGAGAAAGCCATCAAGGAGAAGGAGTACGAGATT<br>GAAAGGTTGAGGGTTCTACTGCAGGAAGAAGGCACCCGGAAGAGAGAAT<br>ATGAAAATGAGCTGGCAAAGGTAAGAAACCACTATAATGAGGAGATGAG<br>TAATTTAAGGAACAAGTATGAAACAGAGATTAACATTACGAAGACCACC<br>ATCAAGGAGATATCCATGCAAAAAGAGGATGATTCCAAAAATCTTAGAA<br>ACCAGCTTGATAGACTTTCAAGGGAAATCGAGATCTGAAGGATGAAAT<br>TGTCAGGCTCAATGACAGCATCTTGCAGGCCACTGAGCAGCGAAGGCGA<br>GCTGAAGAAAACGCCCTTCAGCAAAAGGCCTGTGGCTCTGAGATAATGC<br>AGAAGAAGCAGCATCTGGAGATAGAACTGAAGCAGGTCATGCAGCAGCG<br>CTCTGAGGACAATGCCCGGCACAAGCAGTCCCTGGAGGAGGCTGCCAAG<br>ACCATTCAGGACAAAATAAGGAGATCGAGAGACTCAAAGCTGAGTTTC<br>AGGAGGAGGCCAAGCGCCGCTGGGAATATGAAAATGAACTGAGTAAGGT<br>AAGAAACAATTATGATGAGGAGATCATTAGCTTAAAAAATCAGTTTGAG<br>ACCGAGATCAACATCACCAAGACCACCATCCACCAGCTCACCATGCAGA<br>AGGAAGAGGATACCAGTGGCTACCGGGCTCAGATAGACAATCTCACCCG<br>AGAAAACAGGAGCTTATCTGAAGAATAAAGAGGCTGAAGAACACTCTA<br>ACCCAGACCACAGAGAATCTCAGGAGGGTGGAAGAAGACATCCAACAGC<br>AAAAGGCCACTGGCTCTGAGGTGTCTCAGAGGGAAACAGCAGCTGGAGGT<br>TGAGCTGAGACAAGTCACTCAGATGCGAACAGAGGGAGCGTAAGATAT<br>AAGCAATCTCTTGATGATGCTGCCAAAACCATCCAGGATAAAAACAAGG<br>AGATAGAAAGGTTAAAACAACTGATCGACAAAGAAACAAATGACCGGAA | |

TABLE B-continued

| Gene Fusion | Chimera Sequence | SEQ ID NO. |
|---|---|---|
| | ATGCCTGGAAGATGAAAACGCGAGATTACAAAGGGTCCAGTATGACCTG<br>CAGAAAGCAAACAGTAGTGCGACGGAGACAATAAACAAACTGAAGGTTC<br>AGGAGCAAGAACTGACACGCCTGAGGATCGACTATGAAAGGGTTTCCCA<br>GGAGAGGACTGTGAAGGACCAGGATATCACGCGGTTCCAGAACTCTCTG<br>AAAGAGCTGCAGCTGCAGAAGCAGAAGGTGGAAGAGGAGCTGAATCGG<br>CTGAAGAGGACCGCGTCAGAAGACTCCTGCAAGAGGAAGAAGCTGGAGG<br>AAGAGCTGGAAGGCATGAGGAGGTCGCTGAAGGAGCAAGCCATCAAAAT<br>CACCAACCTGACCCAGCAGCTGGAGCAGGCATCCATTGTTAAGAAGAGG<br>AGTGAGGATGACCTCCGGCAGCAGGGGACGTGCTGGATGGCCACCTGA<br>GGGAAAAGCAGAGGACCCAGGAAGAGCTGAGGAGGCTCTCTTCTGAGGT<br>CGAGGCCCTGAGGCGGCAGTTACTCCAGGAACAGGAAAGTGTCAAACAA<br>GCTCACTTGAGGAATGAGCATTTCCAGAAGGCGATAGAAGATAAAAGCA<br>GAAGCTTAAATGAAAGCAAAATAGAAATTGAGAGGCTGCAGTCTCTCAC<br>AGAGAACCTGACCAAGGAGCACTTGATGTTAGAAGAAGAACTGCGGAAC<br>CTGAGGCTGGAGTACGATGACCTGAGGAGAGGACGAAGCGAAGCGGACA<br>GTGATAAAAATGCAACCATCTTGGAACTAAGGAGCCAGCTGCAGATCAG<br>CAACAACCGGACCCTGGAACTGCAGGGGCTGATTAATGATTTACAGAGA<br>GAGAGGGAAAATTTGAGACAGGAAATTGAGAAATTCCAAAAGCAGGCTT<br>TAGAGGCATCTAATAGGATTCAGGAATCAAAGAATCAGTGTACTCAGGT<br>GGTACAGGAAAGAGAGCCTTCTGGTGAAAATCAAAGTCCTGGAGCAA<br>GACAAGGCAAGGCTGCAGAGGCTGGAGGATGAGCTGAATCGTGCAAAAT<br>CAACTCTAGAGGCAGAAACCAGGGTGAAACAGCGCCTGGAGTGTGAGAA<br>ACAGCAAATTCAGAATGACCTGAATCAGTGGAAGACTCAATATTCCCGCA<br>AGGAGGAGGCTATTAGGAAGATAGAATCGGAAAGAGAAAAGAGTGAGA<br>GAGAGAAGAACAGTCTTAGGAGTGAGATCGAAAGACTCCAAGCAGAGAT<br>CAAGAGAATTGAAGAGAGGTGCAGGCGTAAGCTGGAGGATTCTACCAGG<br>GAGACACAGTCACAGTTAGAAACAGAACGCTCCCGATATCAGAGGGAGA<br>TTGATAAACTCAGACAGCGCCCATATGGGTCCCATCGAGAGACCCAGACT<br>GAGTGTGAGTGGACCGTTGACACCTCCAAGCTGGTGTTTGATGGGCTGAG<br>GAAGAAGGTGACAGCAATGCAGCTCTATGAGTGTCAGCTGATCGACAAA<br>ACAACCTTGGACAAACTATTGAAGGGGAAGAAGTCAGTGGAAGAAGTTG<br>CTTCTGAAATCCAGCCATTCCTTCGGGGTGCAGGATCTATCGCTGGAGCA<br>TCTGCTTCTCCTAAGGAAAAATACTCTTTGGTAGAGGCAAGAGAAAGAA<br>ATTAATCAGCCCAGAATCCACAGTCATGCTTCTGGAGGCCCAGGCAGCTA<br>CAGGTGGTATAATTGATCCCCATCGGAATGAGAAGCTGACTGTCGACAGT<br>GCCATAGCTCGGGACCTCATTGACTTCGATGACCGTCAGCAGATATATGC<br>AGCAGAAAAAGCTATCACTGGTTTTGATGATCCATTTTCAGGCAAGACAG<br>TATCTGTTTCAGAAGCCATCAAGAAAAATTTGATTGATAGAGAAACCGGA<br>ATGCGCCTGCTGGAAGCCCAGATTGCTTCAGGGGGTGTAGTAGACCCTGT<br>GAACAGTGTCTTTTTGCCAAAAGATGTCGCCTTGGCCCGGGGGCTGATTG<br>ATAGAGATTTGTATCGATCCCTGAATGATCCCCGAGATAGTCAGAAAAAC<br>TTTGTGGATCCAGTCACCAAAAAGAAGGTCAGTTACGTGCAGCTGAAGG<br>AACGGTGCAGAATCGAACCACATACTGGTCTGCTCTTGCTTTCAGTACAG<br>AAGAGAAGCATGTCCTTCCAAGGAATCAGACAACCTGTGACCGTCACTG<br>AGCTAGTAGATTCTGGTATATTGAGACCGTCCACTGTCAATGAACTGGAA<br>TCTGGTCAGATTTCTTATGACGAGGTTGGTGAGAGAATTAAGGACTTCCT<br>CCAGGGTTCAAGCTGCATAGCAGGCATATACAATGAGACCACAAAACAG<br>AAGCTTGGCATTTATGAGGCCATGAAAATTGGCTTAGTCCGACCTGGTAC<br>TGCTCTGGAGTTGCTGGAAGCCCAAGCAGCTACTGGCTTTATAGTGGATC<br>CTGTTAGCAACTTGAGGTTACCAGTGGAGGAAGCCTACAAGAGAGGTCT<br>GGTGGGCATTGAGTTCAAAGAGAAGCTCCTGTCTGCAGAACGAGCTGTCA<br>CTGGGTATAATGATCCTGAAACAGGAAACATCATCTCTTTGTTCCAAGCC<br>ATGAATAAGGAACTCATCGAAAAGGGCCACGGTATTCGCTTATTAGAAG<br>CACAGATCGCAACCGGGGGATCATTGACCCAAAGGAGAGCCATCGTTT<br>ACCAGTTGACATAGCATATAAGAGGGGCTATTTCAATGAGGAACTCAGTG<br>AGATTCTCTCAGATCCAAGTGATGATACCAAAGGATTTTTTGACCCCAAC<br>ACTGAAGAAAATCTTACCTATCTGCAACTAAAAGAAAGATGCATTAAGG<br>ATGAGGAAACAGGGCTCTGTCTTCTGCCTCTGAAAGAAAAGAAGAAACA<br>GGTGCAGACATCACAAAAGAATACCCTCAGGAAGCGTAGAGTGGTCATA<br>GTTGACCCAGAAACCAATAAAGAAATGTCTGTTCAGGAGGCCTACAAGA<br>AGGGCCTAATTGATTATGAAACCTTCAAAGAACTGTGTGAGCAGGAATGT<br>GAATGGGAAGAAATAACCATCACGGGATCAGATGGCTCCACCAGGGTGG<br>TCCTGGTAGATAGAAAGACAGGCAGTCAGTATGATATTCAAGATGCTATT<br>GACAAGGGCCTTGTTGACAGGAAGTTCTTTGATCAGTACCGATCCGGCAG<br>CCTCAGCCTCACTCAATTTGCTGACATGATCTCCTTGAAAAATGGTGTCG<br>GCACCAGCAGCAGCATGGGCAGTGGTGTCAGCGATGATGTTTTAGCAGC<br>TCCCGACATGAATCAGTAAGTAAGATTTCCACCATATCCAGCGTCAGGAA<br>TTTAACCATAAGGAGCAGCTCTTTTTCAGACACCCTGGAAGAATCGAGCC<br>CCATTGCAGCCATCTTTGACACAGAAAACCTGGAGAAAATCTCCATTACA<br>GAAGGTATAGAGCGGGGCATCGTTGACAGCATCACGGGTCAGAGGCTTC<br>TGGAGGCTCAGGCCTGCACAGGTGGCATCATCCACCCAACCACGGGCCA<br>GAAGCTGTCACTTCAGGACGCAGTCTCCCAGGGTGTGATTGACCAAGACA<br>TGGCCACCAGGCTGAAGCCTGCTCAGAAAGCCTTCATAGGCTTCGAGGGT<br>GTGAAGGGAAAGAAGAAGATGTCAGCAGCAGAGGCAGTGAAAGAAAAA<br>TGGCTCCCGTATGAGGCTGGCCAGCGCTTCCTGGAGTTCCAGTACCTCAC<br>GGGAGGTCTTGTTGACCCGGAAGTGCATGGGAGGATAAGCACCGAAGAA<br>GCCATCCGGAAGGGGTTCATAGATGGCCGCGCCGCACAGAGGCTGCAAG | |

TABLE B-continued

| Gene Fusion | Chimera Sequence | SEQ ID NO. |
|---|---|---|
| | ACACCAGCAGCTATGCCAAAATCCTGACCTGCCCCAAAACCAAATTAAA<br>AATATCCTATAAGGATGCCATAAATCGCTCCATGGTAGAAGATATCACTG<br>GGCTGCGCCTTCTGGAAGCCGCCTCCGTGTCGTCCAAGGGCTTACCCAGC<br>CCTTACAACATGTCTTCGGCTCCGGGTCCCGCTCCGGCTCCCGCTCGGG<br>ATCTCGCTCCGGATCTCGCTCCGGGTCCCGCAGTGGGTCCCGGAGAGGAA<br>GCTTTGACGCCACAGGGAATTCTTCCTACTCTTATTCCTACTCATTTAGCA<br>GTAGTTCTATTGGGCACTAGTAGTCAGTTGGGAGTGGTTGCTATACCTTG<br>ACTTCATTTATATGAATTTCCACTTTATTAAATAATAGAAAAGAAAATCC<br>CGGTGCTTGCAGTAGAGTGATAGGACATTCTATGCTTACAGAAAATATAG<br>CCATGATTGAAATCAAATAGTAAAGGCTGTTCTGGCTTTTTATCTTCTTAG<br>CTCATCTTAAATAAGCAGTACACTTGGATGCAGTGCGTCTGAAGTGCTAA<br>TCAGTTGTAACAATAGCACAAATCGAACTTAGGATTTGTTTCTTCTCTTCT<br>GTGTTTCGATTTTGATCAATTCTTTAATTTTGGAAGCCTATAATACAGTT<br>TTCTATTCTTGGAGATAAAAATTAAATGGATCACTGATATTTTAGTCATTC<br>TGCTTCTCATCTAAATATTTCCATATTCTGTATTAGGAGAAAATTACCCTC<br>CCAGCACCAGCCCCCCTCTCAAACCCCCAACCCAAAACCAAGCATTTTGG<br>AATGAGTCTCCTTTAGTTTCAGAGTGTGGATTGTATAACCCATATACTCTT<br>CGATGTACTTGTTTGGTTTGGTATTAATTTGACTGTGCATGACAGCGGCAA<br>TCTTTTCTTTGGTCAAAGTTTTCTGTTTATTTTGCTTGTCATATTCGATGTA<br>CTTTAAGGTGTCTTTATGAAGTTTGCTATTCGGCAATAAACTTTTAGACT<br>TTTGAAGTGTTTGTGTTTTAATTTAATATGTTTATAAGCATGTATAAACAT<br>TTAGCATATTTTTATCATAGGTCTAAAAATATTTGTTTACTAAATACCTGT<br>GAAGAAATACCATTAAAAAACTATTTGGTTCTGAATTCTTACTA | |
| CHIA-><br>ZNF138 | AAAGCTTCATGAAACCTCCTCGTCTGTGCACGAACAGGTGGCCGACTCTG<br>GAGCCCAGGCTGTTGCTTTCCAGTCTGGTGGTGAATCCTCCATAGTCTGCT<br>CTGTGTTCTCGTTTTGCCCAAGACCTTTGGCTAGAGCAGAACATAAAGA<br>TTCTTTCCAAAAAGTGACACTGAGCAGATATGGAAAATATGGACATAAG<br>AATTTACAGTTAAGAAAAGGCTGTAAAAGTGTGGATGAGTGTAAGGGAC<br>ACCAAGGAGGTTTAATGGACTTAACCAATGTTTGAAAATTACCACAAGC<br>AAAATATTTCAATGTAATAAATATGTAAAAGTCATGCATAAATTTTCAAA<br>TTCAAATAGACACAAGATAAGACATACTGAAAATAAACATTTCAGATGT<br>AAAGAATGTGACAAATCACTTTGCATGCTTTCACGCCTAACTCAACATAA<br>AAAAATTCATACTAGAGAGAATTTCTACAAATGTGAAGAGTGTGGAAAA<br>ACCTTTAACTGGTCCACAAACCTTTCTAAACCTAAGAAAATTCATACTGG<br>AGAAAAACCCTACAAATGTGAAGTATGTGGAAAAGCCTTTCACCAATCCT<br>CAATCCTTACTAAACATAAGATAATTCGTACTGGAGAAAAACCCTATAAA<br>TGTGCACACTGTGGCAAAGCCTTTAAACAGTCCTCACACCTTACTAGACA<br>TAAGATAATTCATACTGAAGAGAAACCCTACAAATGTGAACAATGTGGC<br>AAGGTCTTTAAGCAGTCCCCAACCCTTACTAAACATCAGATAATTTATAC<br>TGGAGAGGAACCATACAAATGTGAGGAATGTGGCAAAGCTTTTAACCTA<br>TCTTAACAACTTACTGAACATAAGAAAATTTACACTAGAGAGAAAGCCTA<br>CAAATGTGAAGAATGTGGCAAAGCCTTTAACCAGTTTTCAACCCTTATTA<br>CACATAAGATAATTCATAGCGGAGAGAAACCCCACAAATGTGAAGAATG<br>TGGCAGAGCTTTTAACCAGTCCGCAAAGCTCACTGAACATAAGTTAATTC<br>ATACTGGAGAAAAACCCTACAAATGTAAAGAATGTGGAAAAGCTTTTCA<br>CCGATACTCAATCCTTAGTACACATAAGAAAATTCATACTGGGGAGAAAC<br>CCCACAAATGTGGAGAATGCGGAAAAGCCTTTAACTGGTCCTCAACTCTT<br>ATTACACATAAGATAATTCACAGTGGAGAAAAACCCTACAAATGTGAAG<br>AATGTGGCAAAGCTTTTAACCAGTCCTCACACCTTATGAGACATAAGAAA<br>ATTCATAGTAAAGAGAAACCCTACAAATGTGAACAGTGTGGCAAGGTCTT<br>TAAGAAGTCCTCAACTCTTACTGCACATAAGATCATTCATACTGGAGAGA<br>AACCTTACAAATGTGAGGAATGTGGCAAAGGTTTTAGCCAACTCTCAAAC<br>CTTACTAAACACAAGAAGATTCATACTAGAGAGAAACCCTACAAATGTG<br>AAGAATGTGGCATATCTTTTAACCAGTTCTCACAACTTGCTATACATAAG<br>ATGATTCACACTTGAATGAAACCCTACAAATGTGAACGATGTGGCAGTTG<br>TTTTAACTAGTTCTCGAACTTTACTATGCATAAGAAAATTCAAACTGGAG<br>AGAAACTCTACAAATGTGAAGAATGTGGCAAAGCTTTTAACCAAGTCTCA<br>ACACTTACTATACATAAGATAATTTATACTGGAGCAAAACCTTGGAAATT<br>CAAAGAATGTGGTAAAACTTACAATCCTCAAAACTTCTTACACCTAAAAT<br>TCATGCAGGAGAGAAACACCACAAATGTGAAAAATTTGGTAAATTCTTTA<br>ACAAGTCTTCAACCCTTTCTGCACATAATATAATTCATACTGGAGAGAAA<br>CCCCACAAATATGAAGAATGTGGTAATGCTTTTAACCAATTCTCAAATCT<br>TACTAAACAAAATTAATACTGAAAATGTTACAAACCAGAAAAATGTGAA<br>AATGATTTAACAAAACCTTCAAATTTTTCTAAACATAAAGGAAATCATA<br>CTGGTAAGAAATTATAAAAATGTGAAGAATGTGACAAAGCCTTTAAATG<br>GTTGTCACACTTGATTGTAGGTAAGATAATTCATACTGGCAGAAACTCCC<br>AGAAGTGTGAAGAATATGGCAAAACTTTAATTCCTATACCTTATTGCACA<br>GGAAAGCATTTATACTTCAGAAAATGTTGTACTGATATAAAGAATGTAGA<br>AAAGCCATTAAATATGTGCTTACATCTTATTCAACATTAGAGAGTTAGTAC<br>TTAATAAA | SEQ ID<br>NO: 82 |
| ZNF569-><br>SHFM1 | AGCAGCGGAACGATTCGATTCTTCTCAGCACCAAGTTGCGCTCCCAATCT<br>CTCAGAGCTGGGCTCGCGGGAGGCCGCTCGTGCAAAACCTAGGCTGAGC<br>TCCCCTGCGCGGAGCTGTGAGCCCTGGAACACCGTGGTCTGCTTCTCAGG<br>ACGCGCAAACAGTGAAGCCAGTCCCGCCCGGGTGAGCCGCGGGGCCTC<br>TGGGAAGCGTCGCCCCTGGTGTAACGGACCGAGACTTGTGGCGCTCTCAG | SEQ ID<br>NO: 83 |

TABLE B-continued

| Gene Fusion | Chimera Sequence | SEQ ID NO. |
|---|---|---|
|  | CCACCGACAGCGCCGGCCTCAGTGCCGCCTCTGTCCCAGCCCGCGCCGGC TCTGCCACTTTGGCAGCGTTAAGTGTGGAATCGGGGCCTGTGTCCGCGGG CTTGGTGAGTTCTTCATATATTAAGGATTCATTCATTCATAGACTCATTTA TTGAAGGCTGTCTGTGTAACAGGCACAATCCTAGGTGCTTGGGATATAGC AGTGAACAAGAGACAAACCCCCTACTATCATGGTACTTACATTTTTGTGG GCTGGATAATAAACAAGACTGGGCTGGCTTAGATGAAGATGAAGATGCA CATGTCTGGGAGGATAATTGGGATGATGACAATGTAGAGGATGACTTCTC TAATCAGTTACGAGCTGAACTAGAGAAACATGGTTATAAGATGGAGACTT CATAGCATCCAGAAGAAGTGTTGAAGTAACCTAAACTTGACCTGCTTAAT ACATTCTAGGGCAGAGAACCCAGGATGGGACACTAAAAAAATGTGTTTA TTTCATTATCTGCTTGGATTTATTTGTGTTTTTGTAACACAAAAAATAAAT GTTTTGATATAA |  |
| TRIM37->BCAS3 | ATGGATGAACAGAGCGTGGAGAGCATTGCTGAGGTTTTCCGATGTTTCAT TTGTATGGAGAAATTGCGGGATGCACGCCTGTGTCCTCATTGCTCCAAAC TGTGTTGTTTCAGCTGTATTAGGCGCTGGCTGACAGAGCAGAGAGCTCAA TGTCCTCATTGCCGTGCTCCACTCCAGCTACGAGAACTAGTAAATTGTCGT TGGGCAGAAGAAGTAACACAACAGCTTGATACTCTTCAACTCTGCAGTCT CACCCAAACATGAAGAAAATGAAAAGGACAAATGTGAAAATCACCATGAA AAACTTAGTGTATTTTGCTGGACTTGTAAGAAGTGTATCTGCCATCAGTGT GCACTTTGGGGAGGAATGCATGGCGGACATACCTTTAAACCTTTGGCAGA AATTTATGAGCAACACGTCACTAAAGTGAATGAAGAGGTAGCCAAACTT CGTCGGCGTCTCATGGAACTGATCAGCTTAGTTCAAGAAGTGGAAAGGA ATGTAGAAGCTGTAAGAAATGCAAAGATGAGCGTGTTCGGGAAATTAG GAATGCAGTGGAGATGATGATTGCACGGTTAGACACACAGCTGAAGAAT AAGCTTATAACACTGATGGGTCAGAAGACATCTCTAACCCAAGAAACAG AGCTTTTGGAATCCTTACTTCAGGAGGTGGAGCACCAGTTGCGGTCTTGT AGTAAGAGTGAGTTGATATCTAAGAGCTCAGAGATCCTTATGATGTTTCA GCAAGTTCATCGGAAGCCCATGGCATCTTTTGTTACCACTCCTGTTCCACC AGACTTTACCAGTGAATTAGTGCCATCTTACGATTCAGCTACTTTTGTTTT AGAGAATTTCAGCACTTTGCGTCAGAGAGCAGATCCTGTTTACAGTCCAC CTCTTCAAGTTTCAGGACTTTGCTGGAGGTTAAAAGTTTACCCAGATGGA AATGGAGTTGTGCGAGGTTACTACTTATCTGTGTTTCTGGAGCTCTCAGCT GGCTTGCCTGAAACTTCTAAATATGAATATCGTGTAGAGATGGTTCACCA GTCCTGTAATGATCCTACAAAAAAATATCATTCGAGAATTTGCATCTGACT TTGAAGTTGGAGAATGCTGGGCTATAATAGATTTTTTCCGTTTGGACTTA CTCGCAAATGAAGGATACTTGAATCCACAAAATGATACAGTTGATTTTAAG GTTTCAGGTACGTTCACCAACTTTCTTTCAAAAATCCCGGGACCAGCATT GGTACATTACTCAGTTGGAAGCTGCACAGACTAGTTATATCCAACAAATA AACAACCTTAAAGAGAGACTTACTATTGAGCTGTCTCGAACTCAGAAGTC AAGAGATTTGTCACCACCAGATAACCATCTTAGCCCCCAAAATGATGATG CTCTGGAGACACGAGCTAAGAAGTCTGCATGCTCTGACATGCTTCTCGAA GGTGGTCCTACTACAGCTTCTGTAAGAGAGGCCAAAGAGGATGAAGAAG ATGAGGAGAAGATTCAGAATGAAGATTATCATCACGAGCTTTCAGATGG AGATCTGGATCTGGATCTTGTTTATGAGGATGAAGTAAATCAGCTCGATG GCAGCAGTTCCTCTGCTAGTTCCACAGCAACAAGTAATACAGAAGAAAAT GATATTGATGAAGAAACTATGTCTGGAGAAAATGATGTGGAGATATAACA ACATGGAATTAGAAGAGGGAGAACTCATGGAAGATGCAGCTGCTGCAGG ACCCGGCAGGTAGTAGCCATGGTTATGTGGGTTCCAGTAGTAGAATATCAA GAAGAACACATTTATGCTCCGCTGCTACCAGTAGTTTACTAGACATTGAT CCATTAATTTTAATACATTTGTTGGACCTTAAGGACCGGAGCAGTATAGA AAATTTGTGGGGCTTACAGCCTCGCCCACCTGCTTCACTTCTGCAGCCCAC AGCATCCATATTCTCGAAAAGATAAAGACCAAAGGAAGCAACAGGCAATG TGGCGAGTGCCCTCTGATTTAAAGATGCTAAAAAGACTCAAAACTCAAAT GGCCGAAGTTCGATGTATGAAAACTGATGTAAAGAATACACTTTCAGAA ATAAAAAGCAGCAGTGCTGCTTCTGGAGACATGCAGACAAGCCTTTTTTC TGCTGACCAGGCAGCTCTGGCTGCATGTGGAACTGAAAACTCTGCAGAT TGCAGGATTTGGGAATGGAACTCCTGGCAAAGTCATCAGTTGCCAATTGT TACATACGAAACTCCACAAATAAGAAGAGTAATTCGCCCAAGCCAGCTC GATCCAGTGTAGCAGGTAGTCTATCACTTCGAAGAGCAGTGGACCCTGGA GAAAATAGTCGTTCAAAGGGAGACTGTCAGACTCTGTCTGAAGGCTCCCC AGGAAGCTCTCAGTCTGGGAGCAGGCACAGTTCTCCCCGAGCCTTGATAC ATGGCAGTATCGGTGATATTCTGCCAAAAACTGAAGACCGGCAGTGTAA AGCTTTGGATTCAGATGCTGTTTGTGGTTGCAGTTTTCAGTGGCTTGCCTGC GGTTGAGAAAAGGAGGAAAATGGTCACCTTGGGATACATCAAGAAATCT GGAATTTCATGAAATACATAGTACTGGGAATGAACCGCCTTTGTTGATTA TGATTGGCTACAGTGATGGAATGCAGGTCTGGAGCATCCCTATCAGTGGT GAAGCACAAGAGCTCTTCTCTGTTCGACATGGCCCAATTCGAGCGGCTAG AATCTTGCCTGCTCCACAGTTTGGTGCTCAAAAATGTGATAACTTTGCTGA AAAAAGACCCTCCTTGGTGTTTGTAAGAGCATTGGATCTTCTGGCACAA GCCCACCGTACTGTTGTGTGGATCTGTATTCACTTCGTACTGGGGAGATG GTCAAGTCCATTCAATTTAAGACACCTATTTATGATCTCCATTGCAATAAA CGGATCCTTGTCGTAGTCTTGCAGGAGAAAATTGCTGCCTTTGATAGCTG TACTTTCACGAAGAAATTCTTTGTTACAAGCTGCTATCCATGTCCAGGGCC AAACATGAATCCTATTGCTCTTGGGAGCCGCTGGCTTGCTTATGCAGAAA ACAAGTTGATTCGATGTCATCAGTCCCGTGGTGGAGCCTGTGGAGACAAC ATTCAGTCTTATACTGCCACAGTCATTAGTGCTGCTAAAACATTGAAAAG | SEQ ID NO: 84 |

TABLE B-continued

| Gene Fusion | Chimera Sequence | SEQ ID NO. |
|---|---|---|
|  | TGGCCTGACAATGGTAGGGAAAGTGGTGACTCAGCTGACAGGCACACTG<br>CCTTCAGGTGTGACAGAAGATGATGTTGCCATCCACAGTAATTCACGGCG<br>GAGTCCTTTGGTCCCAGGCATCATCACAGTTATTGACACCGAAACCGTTG<br>GAGAGGGCCAGGTGCTTGTGAGTGAGGATTCTGACAGTGATGGCATTGTG<br>GCCCACTTCCCTGCCCATGAGAAGCCAGTGTGCTGCATGGCTTTTAATAC<br>AAGTGGAATGCTTCTAGTCACAACAGACACCCTTGGCCATGACTTTCATG<br>TCTTCCAAATTCTGACTCATCCTTGGTCCTCATCACAATGTGCTGTCCACC<br>ATCTGTATACTCTTCACAGGGGAGAAACTGAAGCCAAAGTACAGGACAT<br>CTGCTTCAGCCATGACTGTCCGCTGGGTTGTGGTCAGTACTCTCCGGGGTA<br>CTTCCCACGTTTTCCCCATCAACCCTTATGGTGGCCAGCCTTGTGTTCGTA<br>CACATATGTCACCACGAGTAGTAATCGCATGAGCCGTTTCCAGAAAAGT<br>GCTGGACTGGAAGAGATTGAACAAGAACTGACGTCTAAGCAAGGAGGTC<br>GCTGTAGCCCTGTTCCAGGTCTATCAAGCAGCCCTTCTGGGTCACCCTTGC<br>ATGGGAAACTGAACAGCCAAGACTCCTATAACAATTTTACCAACAACAA<br>CCCTGGCAACCCTCGGCTCTCTCCTCTTCCCAGCTTGATGGTAGTGATGCC<br>TCTTGCACAAATCAAGCAGCCAATGACATTGGGGACCATCACCAAACGA<br>ACCGGCAAAGTTAAACCTCCTCCACAAATTTCACCCAGCAAATCGATGGG<br>CGGAGAATTTTGTGTGGCTGCTATCTTCGGAACATCCAGGTCATGGTTTG<br>CAAATAATGCAGGTCTGAAAAGAGAAAAAGATCAGTCCAAACAAGTTGT<br>AGTTGAGTCCCTGTACATTATCAGTTGCTATGGCACCTTAGTGGAACACA<br>TGATGGAGCCGCGACCCCTCAGCACTGCACCCAAGATTAGTGACGACAC<br>ACCACTGGAAATGATGACATCGCCTCGAGCCAGCTGGACTCTGGTTAGAA<br>CCCCTCAATGGAATGAATTGCAGCCACCGTTTAATGCAAACCACCCTCTG<br>CTCCTCGCTGCAGATGCAGTACAGTATTATCAGTTCCTGCTTGCTGGCCTG<br>GTTCCCCCTGGAAGTCCTGGGCCCATTACTCGACATGGGTCTTACGACAG<br>TTTAGCTTCTGACCATAGTGGACAGGAAGATGAAGAATGGCTTTCCCAGG<br>TTGAAATTGTAACACACACTGGACCCCATAGACGTCTGTGGATGGGTCCA<br>CAGTTCCAGTTCAAAACCATCCATCCCTCAGGCCAAACCACAGTTATCTC<br>ATCCAGTTCATCTGTGTTGCAGTCTCATGGTCCGAGTGACACGCCACAGC<br>CTCTTTTGGATTTTGATACAGATGATCTTGATCTCAACAGTCTCAGGATCC<br>AGCCAGTCCGCTCTGACCCCGTCAGCATGCCAGGGTCATCCCGTCCAGTC<br>TCTGATCGAAGGGGAGTTTCCACAGTGATTGATGCTGCCTCAGGTACCTT<br>TGACAGGAGCGTGACCCTGCTGGAGGTGTGCGGGAGCTGGCCTGAGGGC<br>TTCGGGCTGCGGCACATGTCCTCCATGGAGCACACGGAGGAGGGCCTCCG<br>GGAGCGACTTGCCGACGCCATGGCCGAGTCACCTAGCCGGGACGTCGTG<br>GGATCCGGAACAGAACTTCAGCGAGAGGGAAGCATCGAGACTCTGAGTA<br>ACAGCTCAGGCTCCACCAGCGGCAGCATACCAAGAAACTTTGATGGCTAC<br>CGATCTCCGCTGCCCACCAATGAGAGCCAGCCCCTCAGCCTCTTCCCGAC<br>TGGCTTCCCGTAG |  |
| PPIL2-><br>NF2 | ATGGGGAAGCGACAGCACCAAAAGGACAAAATATTCTCCAGCTATGTAT<br>CGGGAACCATGATCTATTTATGAGGAGAAGGAAAGCCGATTCTTTGGAA<br>GTTCAGCAGATGAAAGCCCAGGCCAGGGAGGAGAAGGCTAGAAAGCAG<br>ATGGAGCGGCAGCGCCTCGCTCGAGAGAAGCAGATGAGGGAGGAGGCTG<br>AACGCACGAGGGATGAGTTGGAGAGGAGGCTGCTGCAGATGAAAGAAG<br>AAGCAACAATGGCCAACGAAGCACTGATGCGGTCTGAGGAGACAGCTGA<br>CCTGTTGGCTGAAAAGGCCCAGATCACCGAGGAGGAGGCAAAACTTCTG<br>GCCCAGAAGGCCGCAGAGGCTGAGCAGGAAATGCAGCGCATCAAGGCCA<br>CAGCGATTCGCACGGAGGAGGAGAAGCGCCTGATGGAGCAGAAGGTGCT<br>GGAAGCCGAGGTGCTGGCACTGAAGATGGCTGAGGAGTCAGAGAGGAGG<br>GCCAAAGAGGCAGATCAGCTGAAGCAGGACCTGCAGGAAGCACGCGAG<br>GCGGAGCGAAGAGCCAAGCAGAAGCTCCTGGAGATTGCCACCAAGCCCA<br>CGTACCCGCCCATGAACCCAATTCCAGCACCGTTGCCTCCTGACATACCA<br>AGCTTCAACCTCATTGGTGACAGCCTGTCTTTCGACTTCAAAGATACTGA<br>CATGAAGCGGCTTTCCATGGAGATAGAGAAAGAAAAGTGGAATACATG<br>GAAAAGAGCAAGCATCTGCAGGAGCAGCTCAATGAACTCAAGACAGAAA<br>TCGAGGCCTTGAAACTGAAAGAGGGGAGACAGCTCTGGATATTCTGCA<br>CAATGAGAACTCCGACAGGGGTGGCAGCAGCAAGCACAATACCATTAAA<br>AAGCTCACCTTGCAGAGCGCCAAGTCCCGAGTGGCCTTCTTTGAAGAGCT<br>CTAG | SEQ ID<br>NO: 85 |
| LRP8-><br>TMEM48 | ATGGGCCTCCCCGAGCCGGGCCCTCTCCGGCTTCTGGCGCTGCTGCTGCT<br>GCTGCTGCTGCTGCTGCAGCTCCAGCATCTTGCGGCGGCAGCGG<br>CTGATCCGCTGCTCGGCGGCCAAGGGCCGGCCAAGGATTGCGAAAAGGA<br>CCAATTCCAGTGCCGGAACGAGCGCTGCATCCCCTCTGTGTGGAGATGCG<br>ACGAGGACGATGACTGCTTAGACCACAGCGACGAGGACGACTGCCCCAA<br>GAAGACCTGTGCAGACAGTGACTTCACCTGTGACAACGGCCACTGCATCC<br>ACGAACGGTGGAAGTGTGACGGCGAGGAGGAGTGTCCTGATGGCTCCGA<br>TGAGTCCGAGGCCACTTGCACCAAGCAGGTGTGTCCTGCAGAGAAGCTG<br>AGCTGTGGACCCACCAGCCACAAGTGTGTACCTGCCTCGTGGCGCTGCGA<br>CGGGGAGAAGGACTGCGAGGGTGGAGCGGATGAGGCCGGCTGTGCTACC<br>TGCTATATTCCCAAGCTTGGATTAGCACTGCTATGAACCTTCACATAGA<br>TGAGCAGGTTCATAGGCCACTTGACACAGTGAGTGGCCTCTTAAATCTCT<br>CGTTACTCTACCATGTCTGGCTGTGTGGTGTCTTTCTCCTGACGACTTGGT<br>ATGTCTCATGGATACTCTTCAAAATCTATGCCACAGAGGCTCATGTGTTTC<br>CTGTTCAACCACCATTTGCAGAAGGGTCAGATGAGTGCCTTCCAAAAGTG<br>TTAAATAGCAATCCTCCCCCCATCATAAAGTATTTAGCCTTGCAGGACCT | SEQ ID<br>NO: 86 |

TABLE B-continued

| Gene Fusion | Chimera Sequence | SEQ ID NO. |
|---|---|---|
| | GATGTTGCTTTCTCAATATTCTCCTTCACGAAGACAAGAAGTTTTCAGCCT<br>CAGCCAACCAGGTGGACATCCCCACAATTGGACAGCCATTTCAAGGGAG<br>TGTTTGAATCTTTTAAATGGTATGACTCAGAAACTGATTCTCTATCAAGAA<br>GCTGCTGCTACGAATGGGAGAGTGTCTTCATCTTACCCAGTGGAACCTAA<br>GAAATTAAATTCTCCAGAAGAAACTGCTTTTCAGACACCAAAATCTAGCC<br>AGATGCCTCGGCCTTCAGTGCCACCATTAGTTAAAACATCACTGTTTTCTT<br>CAAAATTATCTACACCTGATGTTGTGAGCCCATTTGGGACCCCATTTGGCT<br>CTAGTGTAATGAATCGGATGGCTGGAATTTTTGATGTAAACACCTGCTAT<br>GGGTCACCGCAAAGTCCTCAGCTAATAAGAAGGGGGCCAAGATTGTGGA<br>CATCAGCTTCTGATCAGCAAATGACTGAATTTTCTAATCCTTCTCCATCTA<br>CCTCTATTAGTGCTGAGGGTAAGACAATGAGACAACCCAGTGTGATTTAT<br>TCATGGATTCAGAATAAACGTGAACAGATTAAGAATTTCTTGTCAAAACG<br>GGTGCTGATAATGTATTTTTTCAGTAAGCACCCAGAGGCCTCCATTCAGG<br>CTGTTTTTTCAGATGCCCAAATGCATATTTGGGCATTAGAAGGTCTGTCGC<br>ACTTAGTAGCAGCATCATTTACAGAGGATAGATTTGGAGTTGTCCAGACG<br>ACACTACCAGCTATCCTTAATACTTTGTTGACACTGCAAGAGGCAGTCGA<br>CAAGTACTTTAAGCTTCCTCATGCTTCCAGTAAACCACCCCGGATTTCAG<br>GAAGCCTTGTGGACACTTCATATAAAACATTAAGATTTGCATTCAGAGCA<br>TCACTGAAAACTGCCATCTATCGAATAACTACTACATTTGGTGAACATCT<br>GAATGCTGTGCAAGCATCTGCAGAACATCAGAAAAGACTTCAACAGTTCT<br>TGGAGTTCAAAGAATAG | |
| LUC7L3-><br>HNF1B | ATGATTTCGGCCGCGCAGTTGTTGGATGAGTTAATGGGCCGGGACCGAAA<br>CCTAGCCCCGGACGAGAAGCGCAGCAACGTGCGGTGGGACCACGAGAGC<br>TGTCCTCTACAAGCCTGGTGA | SEQ ID NO: 87 |
| RAD21-><br>FER1L6 | ATGTTCTACGCACATTTTGTTCTCAGTAAAAGAGGGCCTCTGGCCAAAAT<br>TTGGCTAGCGGCCCATTGGGATAAGAAGCTAACCAAAGCCCATGTGTTCG<br>AGTGTAATTTAGAGAGCAGCTGGAGAGTATCATCTCACCAAAGATGTTT<br>GGGCTGAAGGTGAAGAAGAAGAGAAATAAGGCAGAGAAGGGGTTAATC<br>CTAGCCAACAAGGCTGCGAAAGATAGTCAAGGTGACACTGAAGCACTGC<br>AGGAGGAGCCTTCTCACCAGGAAGGACCGAGAGGAGATTGGTCCATGA<br>TGATGCTTCTATCTTTCCTGTCCCCTCAGCTTCTCCAAAGAGAAGATCAAA<br>ACTGTTGACTAAGATCCATGATGGGGAGGTCAGATCCCAAAATTATCAAA<br>TTGCCATAACCATCACCGAGGCTCGCCAGCTGGTGGGTGAGACATTGAC<br>CCAGTTGTGACCATTGAGATTGGGGATGAGAAGAAGCAAAGCACAGTGA<br>AGGAAGGAACCAACAGCCCATTTTATAATGAATACTTTGTCTTCGACTTC<br>ATTGGGCCCCAAGTGCATCTTTTTGACAAGATCATCAAAATCTCCGTCTTT<br>CACCACAAGCTGATAGGAAGTGTACTGATTGGCTCTTTCAAAGTAGACCT<br>GGGGACCGTGTACAACCAACCTGGTCATCAGTTCTGCAACAAGTGGGCCC<br>TGCTCACAGACCCTGGTGACATCAGGACTGGCACCAAGGGGTACCTGAA<br>ATGTGACATCAGTGTCATGGGAAAAGGTGATGTCTTGAAGACCAGCCCTA<br>AAACTTCTGACACCGAGGATGCCAATAGAAAAGAACCTTTTGATCCCCAAT<br>GGGTTTCCACTGGAGAGACCGTGGGCCAGATTCTATGTGAGACTCTACAA<br>AGCAGAAGGGTTGCCCAAAATGAATTCAAGCATCATGGCGAACGTCACC<br>AAGGCATTTGTGGGTGACAGTAAGGACCTGGTGGATCCCTTTGTGGAGGT<br>CTCCTTTGCTGGGCAGATGGGGCGAACCACAGTGCAGAAGACTGTGCTG<br>ATCCTGTGTGGCATGAACAGGTGATCTTCAAGGAAATGTTCCCTCCCTTG<br>TGTCGGAGGGTGAAAATCCAGGTGTGGGATGAAGGCAGCATGAATGACG<br>TAGCCCTGGCAACCCATTTCATTGACCTGAAGAAATCTCCAACGAACAG<br>GATGGGAGACAAAGGCTTTCTGCCCACCTTTGGGCCTGCCTGGATTAACCT<br>GTATGGCTCGCCCAGGAACCACAGTCTGATGGATGACTACCAGGAAATG<br>AACGAAGGCTTTGGGGAAGGTGTGTCATTCAGGGGCAGAATCTTGGTAG<br>AAATTGCTGTGGAAATCCTCTCAGGACGGGCACAGGAATCTAAATTTTCC<br>AAGGCCCTGAAGGAGCTCAAGTTGCCTTCCAAGGACAAAGACTTCCAAAT<br>CTTCCAAAGGTAAAGACAAGGCTGACAAAACTGAAGATGGAAAATCCCA<br>ACAGGCTTCAAACAAAACTAACTCAACCGAGGTGGAGGTGGAATCGTTC<br>GATGTCCCCCGGAGATTGTACCAGAAAAAAATGAGGAATTTTTACTCTT<br>TGGAGCATTTTTTGAAGCTACCATGATTGACCGGAAGATTGGAGATAAAC<br>CCATCAGCTTTGAAGTTTCTATTGGTAATTTTGGAAACCTGATTGATGGAG<br>GATCCCATCATGGGAGTAAGAAGTCAGCTGAATCAGCTGAAGAAGACCT<br>CCTTCCACTGCTTCACGAAGGGCAAGGGGATGTGGCCCATGATGTTCCCA<br>TTCCTATGCCTCCACCACTCACCCGGAGAAGCCACTGGTGACAGAAGGG<br>AACAGGAATTACAACTATTTGCCATTTGAGGCTAAGAAGCCCTGTGTCTA<br>TTTCATCAGCTCTTGGGGAGACCAGACCTTCAGGCTGCACTGGTCCAACA<br>TGCTGGAGAAAATGCAGACTTCCTGGAAGAAAGTATAGAAGAAGTGAG<br>AGAATTGATCAAGATTTCACAGGAGGCACCTGAAGAGAAAATGAAAACA<br>GTGCTCAGTGACTTCATCAGTCGGAGCAGTGCCTTTATCTCTGAAGCAGA<br>AAAAAAGCCCAAGATGTTGAACCAAACCACTTTAGATAAGAAGCGACTT<br>ACGCTCTGCTGGCAGGAGCTGGAAGCAATGTGCAAGGAGGCCAAGGGGA<br>TCATTCAGCAGCAGAAGAAAAGTTATCTGTTGATGAAATGATTCACGAA<br>GCCCAAAACTTTGTGGAAAAAATCCGCTTTCTTGTTGATGAGCCCCAGCA<br>CACTATCCCTGACGTTTTCATCTGGATGCTCAGCAACAACAGGAGAGTGG<br>CCTATGCCCGCATCGCCTCCAAAGACCTCCTCTATTCCCCTGTCGCGGGGC<br>AGATGGGCAAACACTGCGGCAAGATCAAAACTCACTTCCTCAAACCTCCT<br>GGGAAACGACCGGCTGGTTGGTCTGTGCAAGCAAAAGTCGACGTGTACC<br>TGTGGCTGGGCTCCATCAAGCATGCCAGTGCCATTTGGACAACTTGCCA | SEQ ID NO: 88 |

TABLE B-continued

| Gene Fusion | Chimera Sequence | SEQ ID NO. |
|---|---|---|
| | GTAGGCTATGAAGCAGAAATGTCCTCCAAAGGGGCTGGCACCAATCACC<br>CCCCATCTAACCTGCTCTACCAAGAACAGCATGTTTTTCAGCTGAGGGCT<br>CACATGTACCAAGCCCGGGGCCTCATCGCAGCTGACAGCAATGGACTTTC<br>AGACCCTTTTGCCAAAGTCACGTTCCTTTCTCACTGCCAGACAACAAAGA<br>TAATCTCCAGACCCTCTCTCCGACCTGGAACCAGATGCTGCTGTTCAAT<br>GATTTGGTGCTGCATGGAGATGTGAAGGAGCTGGCAGAGTCCCCGCCCTT<br>AGTGGTGGTGGAGCTGTATGACAGCGACGCTGTGGGGAAGCCAGAATAT<br>TTGGGTGCCACAGTGGCTGCTCCTGTTGTGAAGCTGGCTGACCAGGACTA<br>TGAGCCCCCCAGGTTATGCTATCACCCCATCTTTTGTGGGAATCTCTCTGG<br>AGGGGATCTCCTTGCTGTATTTGAACTGCTGCAGGTTCCTCCTTCTGGGCT<br>GCAAGGCCTCCCACCCGTTGAGCCACCAGACATCACCCAGATCTACCCGG<br>TTCCTGCCAACATTCGGCCGGTGCTGAGCAAATACCGAGTGGAGGTTCTC<br>TTCTGGGGAGTTCGGGAAATGAAGAAGGTGCAGCTCCTCTCTGTGGATCG<br>GCCTCAGGCTCTCATTGAGTGCGGAGGACAAGGTGTGAAGTCCTGCGTGA<br>TCCAGAGCTACAAGAACAACCCGAACTTCAGCATCCAGGCAGACGCTTTC<br>GAAGTGGAACTGCCTGAGAACGAGCTTCTGCACCCGCCACTGAGCATCTG<br>CGTGGTGGACTGGAGAGCTTTTGGGAGGAGTACCCTTGTGGGCACCTACA<br>CCATCAACTACTTGAAGCAGTTTTTGTGTAAACTCAGAGAGCCCCTTGCC<br>CCCATCACACAGGTGGATGGAACCCAGCCTGGGCACGATATTTCAGATTC<br>GCTAACAGCCACTGAGTCCTCTGGAGCCCACAGCTCCTCCCAGGATCCCC<br>CAGCAGATCACATTTATGTGGATGTTGAGCCACCTCCCACAGTGGTGCCC<br>GACTCTGCCCAGGCCCAGCCGGCCATCTGGTTGACGTCCTGACTCATC<br>CCCGATGCTGGAGCCTGAACACACACCTGTAGCCCAGGAGCCACCAAAA<br>GATGGAAAACCTAAGGATCCCAGGAAGCCTTCCCGGAGGTCCACTAAGA<br>GGAGAAAGAGGACCATAGCAGATGAATCTGCTGAAAACGTGATTGACTG<br>GTGGTCTAAGTATTATGCCTCCCTGAAGAAAGCCCAGAAGGCAAAGGAG<br>AGAAATCCCAAGGGAAAAAAAGGCAATACAGAGGCAAAGCCAGATGAG<br>GTAGTGGTAGATATAGAAGATGGGCCAAAGAAGAAGAAAGACAAAATG<br>CTCAAGAAGAAACCCAAAGATGATGGAATCCCCAACCTGGCCATCTTGC<br>AGATATATGACGGTGATCTCGAGAGTGAATTCAACAATTTTGAAGACTGG<br>GTGAAAACTTTTGAGCTCTTCAGAGGCAAGTCTACGGAAGATGACCATGG<br>TCTTGATGGAGACCGAGTCATAGGAAATTTAAGGGCTCCTTCTGCATCT<br>ACAAAAGCCCCCAGGATTCTAGCTCTGAGGACAGCGGGCAGCTGAGAAT<br>CCAGCAAGGGATTCCGCCCAATCACCCTGTCACAGTGCTGATCGGCAAATAT<br>ACATTGTCGCGCATTTAATCTTAGTCCAGCTGATCCAGATGGCAAATCA<br>GATCCCTACATTGTGATCAAGCTTGGCAAGACAGAAATCAAAGACCGGG<br>ATAAATACATCCCTAAACAACTGAACCCAGTATTTGGAAGGTCATTTGAG<br>ATCCAAGCCACATTCCCAAAAGAGTCCCTGCTCTCCATCCTGATCTATGA<br>CCATGACATGATTGGCACAGATGACCTTATTGGTGAGACCAAGATCGACC<br>TGGAGAACCGCTTCTACAGCAAACACCGAGCCATCTGTGGCTTGCAGAGC<br>CAGTATGAGATAGAAGGATACAATGCCTGGAGAGACACGTCCAAACCCA<br>CCGAAATCCTCACTAAGCTCTGCAAAGACAACAAGCTGGATGGACCCTAC<br>TTTCACCCTGGGAAAATACAGATAGGAAACCAAGTCTTTTCTGGAAAAAC<br>TATCTTCACTGAAGAGGACACTGATGAGACAGTGGAGTCTTATGAACACC<br>TGGCCCTCAAGGTTTTACACTCTTGGGAGGATATCCCGGAAGTCGGGTGT<br>AGGCTGGTTCCTGAACACATAGAAACTCGGCCACTGTACCACAAGGATA<br>AGCCAGGAATGGAGCAGGGCCGCCTGCAGATGTGGGTGGACATGTTTCC<br>CAAGGATATGCCTCAACCTGGACCTCCTGTTGACATCTCTCCAAGGCGAC<br>CCAAAGGATACGAATTGAGAGTGACCATCTGGAACACTGAAGATGTCAT<br>TTTAGAGGATGAGAATATCTTCACAGGCCAAAAATCAAGTGATATTTATG<br>TGAAAGGGTGGTTAAAGGGCTTGGAGGATGACAAGCAGGAGACAGATGT<br>GCATTACAACTCCCTGACTGGAGAGGGCAACTTCAACTGGCGCTTCCTGT<br>TTCCCTTTCAGTATCTCCCAGCTGAGAAGCAAATGGTCATTACCAAGAGG<br>GAGAACATCTTCTCTTTAGAGAAGATGGAGTGTAAGACTCCTGCTGTGTT<br>GGTGCTGCAGGGTTTGGGATTTTGAAAGGCTGTCCTCAGATGACTTCCTGG<br>GCACCCTGGAAATGAACCTCAACAGTTTCCCTCGAGCAGCTAAGTCTGCC<br>AAAGCCTGTGATCTTGCCAAGTTTGAAAATGCAAGTGAGGAGACCAAGA<br>TCTCTATATTCCAGCAAAAACGTGTGCGTGGCTGGTGGCCTTTTTCTAAAA<br>GCAAAGAACTCACAGGCAAGGTTGAAGCTGAGTTCCACCTAGTTACAGC<br>AGAAGAAGCTGAGAAAAATCCTGTTGGAAAAGCCCGAAAGGAGCCAGA<br>GCCCCTGGCCAAGCCCAACCGCCCAGACACCTCCTTTTCGTGGTTCATGA<br>GCCCCTTTAAGTGCCTGTACTACCTCATCTGGAAGAATTACAAAAGTAC<br>ATCATCATTGCTTTCATTCTCATCATCCTCATCATCTTCCTCGTCCTTTTCA<br>TCTACACCTTGCCAGGAGCCATCAGCCGAAGGATCGTTGTGGGCTCATAG | |
| AP2B1-><br>FLJ42280 | ATGACTGACTCCAAGTATTTCACAACCAATAAAAAGGAGAAATATTTGA<br>ACTAAAAGCTGAACTCAACAATGAAAAGAAAGAAAAGAGAAAGGAGGC<br>TGTGAAGAAAGTGATTGCTGCTATGACCGTGGGGAAGGATGTTAGTTCTC<br>TCTTTCCAGACGTAGTGAACTGTATGCAGACTGACAATCTGGAACTAAAG<br>AAGCTTGTGTATCTCTACTTGATGAACTACGCCAAGAGTCAGCCAGACAT<br>GGCCATCATGGCTGTAAACAGCTTTGTGAAGGACTGTGAAGATCCTAATC<br>CTTTGATTCGAGCCTTGGCAGTCAGAACCATGGGGTGCATCCGGGTAGAC<br>AAAATTACAGAATATCTCTGTGAGCCGCTCCGCAAGTGCTTGAAGGATGA<br>GGATCCCTATGTTCGGAAAACAGCAGCAGTCTGCGTGGCAAAACTCCATG<br>ATATCAATGCCCAAATGGTGGAAGATCAGGGATTTCTGGATTCTCTACGG<br>GATCTCATAGCAGATTCAAATCCAATGGTGGTGGCTAATGCCGTAGCGGC<br>ATTATCTGAAATCAGTGAGTCTCACCCCAAACAGCAACTTACTTGATCTGA | SEQ ID NO: 89 |

TABLE B-continued

| Gene Fusion | Chimera Sequence | SEQ ID NO. |
|---|---|---|
| | ACCCACAGAACATTAATAAGCTGCTGACAGCCCTGAATGAATGCACTGA ATGGGGCCAGATTTTCATCCTGGACTGCCTGTCTAATTACAACCCTAAAG ATGATCGGGAGGCTCAGAGCATCTGTGAGCGGGTAACTCCCCGGCTATCC CATGCCAACTCAGCAGTGGTGCTTTCAGCGGTAAAAGTCCTAATGAAGTT TCTAGAATTGTTACCTAAGGATTCTGACTACTACAATATGCTGCTGAAGA AGTTAGCCCCTCCACTTGTCACTTTGCTGTCTGGGGAGCCAGAAGTGCAG TATGTCGCCCTGAGGAACATCAACTTAATTGTCCAGAAAAGGCCTGAAAT CTTGAAGCAGGAAATCAAAGTCTTCTTTGTGAAGTACAATGATCCCATCT ATGTTAAACTAGAAGAAGTTGGACATCATGATTCGTTTGGCATCTCAAGCC AACATTGCTCAGGTTCTGGCAGAACTGAAAGAATATGCTACAGAGGTGG ATGTTGACTTTGTTCGAAAAGCTGTGCGGGCCATTGGACGGTGTGCCATC AAGGTGGAGCAATCTGCAGAGCGCTGTGTAAGCACATTGCTTGATCTAAT CCAGACCAAAGTGAATTATGTGGTCCAAGAAGCAATTGTTGTCATCAGGG ACATCTTCCGCAAATACCCCAACAAGTATGAAAGTATCATCGCCACTCTG TGTGAGAACTTAGACTCGCTGGATGAGCCAGATGCTCGAGCAGCTATGAT TTGGATTGTGGGAGAATATGCTGAAAGAATTGACAATGCAGATGAGTTAC TAGAAAGCTTCCTGGAGGGTTTTCACGATGAAAGCACCCAGGTGCAGCTC ACTCTGCTTACTGCCATAGTGAAGCTGTTTCTCAAGAAACCATCAGAAAC ACAGGAGCTAGTCCAGCAGGTCTTGAGTTTGGCAACACAGGACTCCAAC ATTTGTGCTGTGTTTGCTGTACAAGGAGGAAAGTGGGAAGAAAGCATG GCATAAAAGGGGGAGGAGACCCAGCATAAGAAGCCCAGCTCAGCGGG CCAGAGGACCCTGGATCCATGAGAGTAAGCATCCGGCCTTTGCAAAGCA ACAGATAAACTTGGAGATGCCCAACTCCAGAGCGACAACAGAGTTAGCC TGGGTCTGCAGCTCCACCTCAAGAAAAAAGAAGTGGGCAAGGTCCCTGA CTCTTTCCACTGCTCCACTGAGCCCCCCACCATCCTTGGTGCACTGTGAAG ATTGTTCTTGCCTGCCTGGCTGCCATTCGGGTGACCTCTACAATCTGGCCC CAGCAGAAAGAACTTGCTAG | |
| RUFY3-> MUC7 | ATGTCTGCTCTGACGCCTCCGACCGATATGCCAACCCCCACCACTGACAA GATCACACAGGCTGCCATGGAGACCATCTACCTTTGCAAATTCCGATGT CCATGGATGGAGAATGGCTCTGCCTGCGAGAGCTGGATGACATCTCACTT ACACCTGACCCAGAGCCTACCCATGAAGATCCTAATTATCTCATGGCTAA TGAACGCATGAACCTCATGAACATGGCCAAGCTGAGTATCAAGGGCTTG ATTGAATCAGCTCTGAACCTGGGGAGGACTCTTGACTCTGACTATGCACC TCTCCAGCAATTCTTTGTGGTGATGGAGCACTGTCTGAAACATGGCTTGA AAGCTAAAAAACTTTTCTCGGACAAAATAAATCCTTCTGGGGGCCTCTA GAACTGGTAGAAAAGCTTGTTCCAGAAGCCGCAGAGATAACAGCAAGTG TTAAAGATCTTCCAGGACTTAAGACACCAGTAGGTAGAGGAAGAGCCTG GCTTCGTTTGGCATTAATGCAAAAGAAACTTTTCAGAATATATGAAAGCTT TGATCAATAAGAAAGAACTTCTCAGTGAATTCTACGAACCCAATGCCCTC ATGATGGAAGAAGAAGGAGCCATAATTGCTGGTCTGTTGGTGGGTCTGA ATGTCATTGATGCCAATTTCTGTATGAAAGGAGAAGACTTGGACTCTCAG GTTGGAGTTATAGATTTTTCAATGTATCTCAAGGACGGGAACAGCAGTAA AGGTACTGAAGGAGACGGTCAGATTACTGCAATTCTGGACCAGAAGAAC TATGTAGAAGAACTGAACAGACATTTGAATGCTACTGTAAACAACCTTCA GGCAAAGTAGATGCATTAGAAAAATCCAACACTAAACTGACAGAGGAG CTTGCAGTTGCAAACAACAGGATCATTACCTTACAAGAAGAAATGGAAC GAGTTAAAGAGGAAAGTTCCTACATACTGGAATCCAATCGGAAGGGTCC CAAGCAAGACAGAACTGCAGAAGGGCAAGCACTAAGTGAAGCAAGAAA GCATTTAAAAGAAGAGACACAATTACGATTGGATGTTGAGAAAGAACTG GAGATGCAGATCAGCATGAGGCAGGAGATGGAATTGGCTATGAAGATGC TGGAGAAGGATGTCTGTGAGAAGCAGGATGCCCTGGTATCTCTTCGGCAG CAGCTGGATGACCTCAGAGCTCTCAAGCATGAACTTGCCTTTAAGCTGCA GAGTTCAGACTTAGGAGTAAAACAGAAAGTGAACTAAACAGTCGCTTG GAAGAGAAGACTAATCAGATGGCTGCTACCATTAAACAACTTGAACAAA GATTGCGCCAGGCTGAGCGAAGCCGCCAATCTGCTGAGTTGGACAACCG GCTCTTCAAACAGGACTTTGGAGACAAGATCAACAGTCTGCAGCTGGAA GTCGAGGAGCTCACCAGGCAGCGGAACCAGCTTGAGTTAGAACTAAAAC AGGAAAAAGAAAGAAGATTACAAAACGACAGGAGCATCCCAGGAAGGG GTTCCCAGAAGTCAGAATCCAAGATGGATGGGAAGCACAAAATGCAAGA GGAAAATGTTAAACTAAAAAAGCCCCTGGAAGAAAGCCACAGGCTGCAA CCCCACCCTATGGATGAACAGGATCAGCTGCTGCTCTGAAAAGCCACA GTTGTGTCAGCTATGCCAGGAAGACGGCAGCCTAACAAAGATGAAAACT CTGCCGCTGTTTGTGCATCTGTGCACTGAGTGCTGCTTCTCGTTCAGT GAAGGTCGAGAAAGGGATCATGAACTACGTCACAGAAGGCATCATCACC AATCACCCAAATCTCACTTTGAATTACCACATTATCCTGGACTGCTAGCTC ACCAGAAGCCGTTCATTAGAAAGTCCTATAAATGTCTGCACAAACGCTGT AGGCCTAAGCTTCCACCTTCACCTAATAACCCCCCAAATTCCCAAATCC TCACCAGCCACCTAAACATCCAGATAAAAATAGCAGTGTGGTCAACCCTA CCTTAGTGGCTACAACCCAAATTCCATCTGTGACTTTCCCATCAGCTTCCA CCAAAATTACTACCCTTCCAAATGTGACTTTTCTTCCCCAGAATGCCACCA CCATATCTTCAAGAGAAATGTTAACACAAGCTCTTCTGTAGCTACATTA GCACCAGTGAATTCCCCAGCTCCACAAGACACCACAGCTGCCCCACCCAC ACCTTCTGCAACTACACCAGCTCCACCATCTTCCTCAGCTCCACCAGAGA CCACAGCTGCCCCACCCACACCTTCTGCAACTACACAAGCTCCACCATCT TCCTCAGCTCCACCAGAGACCACAGCTGCCCCACCCACACCTCCTGCAAC TACACCAGCTCCACCATCTTCCTCAGCTCCACCAGAGACCACAGCTGCCC | SEQ ID NO: 90 |

TABLE B-continued

| Gene Fusion | Chimera Sequence | SEQ ID NO. |
|---|---|---|
| | CACCCACACCTTCTGCAACTACACCAGCTCCACTATCTTCCTCAGCTCCAC<br>CAGAGACCACAGCTGTCCCACCCACACCTTCTGCAACTACCCTAGACCCA<br>TCATCCGCCTCAGCTCCACCAGAGACCACAGCTGCCCCACCCACACCTTC<br>TGCAACTACACCAGCTCCACCGTCTTCCCCAGCTCCACAAGAGACCACAG<br>CTGCCCCAATTACCACACCTAATTCTTCCCCAACTACTCTTGCACCTGACA<br>CTTCTGAAACTTCAGCTGCACCCACACACCAGACTACTACTTCGGTCACT<br>ACTCAAACTACTACTACTAAACAACCAACTTCAGCTCCTGGCCAAAATAA<br>AATTTCTCGATTTCTTTTATATATGAAGAATCTACTAAACAGAATTATTGA<br>CGACATGGTGGAGCAATAG | |
| LLGL2 -><br>CPNE4 | GGAGGTGAGCAGGAAGGAGACGGCCGCCCAGCAGCCCGTGGGCAGGCG<br>CGGCGGAGCGAGCGGGCCGGCGGCGGGCGCCGAGGGACGCCGAGGCC<br>TCGGGCGGGGGCTGGCCCGGGGTTCCAGGTTGACAGGACTGAGGTGATT<br>CGCACCTGCATAAACCCAGTGTACTCAAAACTGTTTACTGTGGACTTTTA<br>CTTTGAGGAGGTGCAGCGCCTGCGGTTTGAAGTCCATGACATCAGCAGCA<br>ACCACAATGGGCTGAAGGAGGCCGACTTCCTTGGTGGCATGGAGTGCAC<br>ACTTGGCCAGATTGTTTCCCAGAGAAAGCTGTCCAAATCCTTGCTGAAGC<br>ATGGGAACACAGCAGGGAAATCTTCCATCACGGTGATTGCTGAAGAATT<br>ATCTGGCAATGACGACTATGTTGAGCTTGCATTCAATGCACGGAAATTGG<br>ATGACAAGGATTTCTTCAGTAAATCTGACCCATTTCTGGAAATTTTTCGTA<br>TGAATGATGATGCAACTCAGCAGCTGGTGCACCGAACTGAGGTTGTGATG<br>AATAACTTAAGCCCAGCCTGGAAATCATTCAAAGTATCTGTAAATTCTCT<br>ATGCAGCGGAGACCCAGACCGCCGGCTAAAGTGCATAGTATGGGACTGG<br>GACTCCAATGGCAAGCATGACTTCATTGGAGAATTCACCTCGACATTCAA<br>GGAGATGAGAGGAGCAATGGAAGGGAAACAGGTGCAGTGGGAGTGCAT<br>CAATCCCAAGTACAAAGCCAAGAAGAAGAATTACAAGAACTCAGGCACT<br>GTGATTCTGAATCTGTGCAAGATTCACAAGATGCATTCTTTCTTGGACTAC<br>ATCATGGGTGGCTGCCAAATCCAGTTTACAGTAGCTATAGATTTCACTGC<br>CTCAAACGGGGACCCCAGGAACAGCTGTTCCTTGCACTACATCCACCCTT<br>ACCAACCCAATGAGTATCTGAAAGCTTTGGTAGCTGTGGGGGAGATTTGC<br>CAAGACTATGACAGTGACAAAATGTTCCCTGCCTTTGGGTTTGGCGCCAG<br>GATACCTCCAGAGTACACGGTCTCTCATGACTTTGCAATCAACTTTAATG<br>AAGACAACCCAGAATGTGCAGGAATTCAAGGAGTTGTGGAAGCCTATCA<br>GAGCTGTCTTCCTAAGCTCCAACTCTACGGTCCCACCAACATTGCCCCCAT<br>CATCCAGAAGGTTGCCAAGTCAGCGTCAGAGGAAACTAACACCAAGGAG<br>GCATCGCAATACTTCATCCTGCTGATCCTGACAGATGGTGTTATCACAGA<br>CATGGCCGACACCCGGGAGGCCATTGTCCATGCCTCCCACCTCCCCATGT<br>CAGTCATCATCGTGGGAGTAGGGAACGCTGACTTCAGTGACATGCAGATG<br>CTGGACGGTGATGATGGGATTCTGAGGTCACCCAAGGGAGAGCCTGTTCT<br>TCGAGACATCGTCCAGTTCGTGCCCTTCAGGAACTTCAAACACGCATCTC<br>CAGCTGCCCTGGCAAAGAGCGTGCTGGCTGAAGTCCCAAACCAAGTTGTG<br>GACTATTACAATGGCAAAGGAATTAAACCAAAATGTTCATCAGAAATGT<br>ATGAATCTTCCAGAACACTAGCACCATGAACTCCCCACACAGTTTTACAG<br>AGTTCTGAAATACTATTCCTGCTAATATTTCATATTTAATACTTCTACTAC<br>TCCTGTACTTTAAAAAACCAACAACATATACACATTTAAAAATAGCACGT<br>TTTGGTGATTTTTAACTATCTGACAATTTTTTTTGCATGTGTAGCCCTGAG<br>GCCTGGATCTGTTAAGCCCTTGTATTGTTAACTTTTTACAAAGAAACACA<br>GATAACAATAACTTACTATTTACATTACAGCATGTCGCCTTGAAATAAAA<br>TGGTATCTGTATCCATTTTTTATACAGGTTTGTTGAAATTTTGCTAAATTTC<br>TTATCTTTACACTCTAAAGCATTTTGAAACATTTACTGAATGTTGATAGAC<br>GAAATATACTTGGTTTTATCTGCTATAGGATGAGAGACTTTTTAAAATGG<br>CAGATGCATGGACTGTATTTTGCATGTTTAAAATAA | SEQ ID<br>NO: 91 |
| SEMA4C -><br>BRE | ATGGCCCCACACTGGGCTGTCTGGCTGCTGGCAGCAAGGCTGTGGGGCCT<br>GGGCATTGGGGCTGAGGTGTGGTGGAACCTTGTGCCGCGTAAGACAGTGT<br>CTTCTGGGGAGCTGGCCACGGTAGTACGGCGGTTCTCCCAGACCGGCATC<br>CAGGACTTCCTGACACTGACGCTGACGGAGCCCACTGGGCTTCTGTACGT<br>GGGCGCCCGAGAGGCCCTGTTTGCCTTCAGCATGGAGGCCCTGGAGCTGC<br>AAGGAGCGATCTCCTGGGAGGCCCCCGTGGAGAAGAAGACTGAGTGTAT<br>CCAGAAAGGGAAGAACAACCAGACCGAGTGCTTCAACTTCATCCGCTTCC<br>TGCAGCCCTACAATGCCTCCCACCTGTACGTCTGTGGCACCTACGCCTTCC<br>AGCCCAAGTGCACCTACGTCAACATGCTCACCTTCACTTTGGAGCATGGA<br>GAGTTTGAAGATGGGAAGGGCAAGTGTCCCTATGACCCAGCTAAGGGCC<br>ATGCTGGCCTTCTTGTGGATGGTGAGCTGTACTCGGCCAGCTCAACAAC<br>TTCCTGGGCACGGAACCCATTATCCTGCGTAACATGGGGCCCCACCACTC<br>CATGAAGACAGAGTACCTGGCCTTTTGGCTCAACGAACCTCACTTTGTAG<br>GCTCTGCCTATGTACCTGAGAGTGTGGGCAGCTTCACGGGGACGACGAC<br>AAGGTCTACTTCTTCTTCAGGGAGCGGGCAGTGGAGTCCGACTGCTATGC<br>CGAGCAGGTGGTGGCTCGTGTGCCCGTGTCTGCAAGGGCGATATGGGG<br>GGCGCACGGACCCTGCAGAGGAAGTGGACCACGTTCCTGAAGGCGCGGC<br>TGGCATGCTCTGCCCCGAACTGGCAGCTCTACTTCAACCAGCTGCAGGCG<br>ATGCACACCCTGCAGGACACCTCCTGGCACAACACCACCTTCTTTGGGGT<br>TTTTCAAGCACAGTGGGGTGACATGTACCTGTCGGCCATCTGTGAGTACC<br>AGTTGGAAGAGATCCAGCGGGTGTTTGAGGGCCCCTATAAGGAGTACCA<br>TGAGGAAGCCCAGAAGTGGGACCGCTACACTGACCCTGTACCCAGCCCTC<br>GGCCTGGCTCGTGCATTAACAACTGGCATCGGCGCCACGGCTACACCAGC<br>TCCCTGGAGCTACCCCGACAACATCCTCAACTTCGTCAAGAAGCACCCGCT | SEQ ID<br>NO: 92 |

TABLE B-continued

| Gene Fusion | Chimera Sequence | SEQ ID NO. |
|---|---|---|
| | GATGGAGGAGCAGGTGGGGCCTCGGTGGAGCCGCCCCCTGCTCGTGAAG AAGGGCACCAACTTCACCCACCTGGTGGCCGACCGGGTTACAGGACTTGA TGGAGCCACCTATACAGTGCTGTTCATTGGCACAGGAGACGGCTGGCTGC TCAAGGCTGTGAGCCTGGGGCCCTGGGTTCACCTGATTGAGGAGCTGCAG CTGTTTGACCAGGAGCCCATGAGAAGCCTGGTGCTATCTCAGAGCAAGAA GCTGCTCTTTGCCGGCTCCCGCTCTCAGCTGGTGCAGCTGCCCGTGGCCG ACTGCATGAAGTATCGCTCCTGTGCAGACTGTGTCCTCGCCCGGGACCCC TATTGCGCCTGGAGCGTCAACACCAGCCGCTGTGTGGCCGTGGGTGGCCA CTCTGGATCTCTACTGATCCAGCATGTGATGACCTCGGACACTTCAGGCA TCTGCAACCTCCGTGGCAGTAAGAAAGGGCTTATTTCAAAACCTTTGTCC CTCAGTTCCAGGAGGCAGCATTTGCCAATGAAAGCTCTAGGAAACACC AGTCTTGAGAGGTGGCCAGCCAGACTGCCTGTCCACATGCGTGTCAGCAC ATACAGCCGCTTCCTGGAAGCCGCCTGGAATGTCTTCACGGCAGCGTTTT GCTCACACAGCAGCTTTTGCACGCCCCAGGCAGCCCCGACTGCTGAAATC CAACTTGAGCTGGCTGGTGGTCCCTGGATCCTAGAGCCCTTCACTTCGGG TTACTCCCTCTTTCTTGCCTCTATTTCTTAGTTGGAAGAAATAAACTCACA AATTTATGGTGCAGTAATTTTCCGGGGAAAGTAAAGCCTCAGGAATGCCCA CGCCTTTCTTCCAAAGCCTTTGTCTCTGAGACCTCTTAAGTTCTAAGATTA AATGCCCCTCGCTGTTCTTCCTCTGAAA | |
| ESR1-> AKAP12 | ATGACCATGACCCTCCACACCAAAGCATCTGGGATGGCCCTACTGCATCA GATCCAAGGGAACGAGCTGGAGCCCCTGAACCGTCCGCAGCTCAAGATC CCCCTGGAGCGGCCCCTGGGCGAGGTGTACCTGGACAGCAGCAAGCCCG CCGTGTACAACTACCCCGAGGGCGCCGCCTACGAGTTCAACGCCGCGGCC GCCGCCAACGCGCAGGTCTACGGTCAGACCGGCCTCCCCTACGGCCCCGG GTCTGAGGCTGCGGCGTTCGGCTCCAACGGCCTGGGGGGTTTCCCCCCAC TCAACAGCGTGTCTCCGAGCCCGCTGATGCTACTGCACCCGCCGCCGCAG CTGTCGCCTTTCCTGCAGCCCCACGGCCAGCAGGTGCCCTACTACCTGGA GAACGAGCCCAGCGGCTACACGGTGCGCGAGGCCGGCCCGCCGGCATTC TACAGGCCAAATTCAGATAATCGACGCCAGGGTGGCAGAGAAAGATTGG CCAGTACCAATGACAAGGGAAGTATGGCTATGGAATCTGCCAAGGAGAC TCGCTACTGTGCAGTGTGCAATGACTATGCTTCAGGCTACCATTATGGAG TCTGGTCCTGTGAGGGCTGCAAGGCCTTCTTCAAGAGAAGTATTCAAGGA CATAACGACTATATGTGTCCAGCCACCAACCAGTGCACCATTGATAAAAA CAGGAGGAAGAGCTGCCAGGCCTGCCGGCTCCGTAAATGCTACGAAGTG GGAATGATGAAAGGTGTTGGACAGAGAGACTCTGAAGATGTGCAGCAAAA GAGACTCCGATAAAGAGATGGCTACTAAGTCAGCGGTTGTTCACGACATC ACAGATGATGGGCAGGAGGAGACACCCGAAATAATCGAACAGATTCCTT CTTCAGAAAAGCAATTTAGAAGAGCTAACACAACCCACTGAGTCCCAGGCT AATGATATTGGATTTAAGAAGGTGTTTAAGTTTGTTGGCTTTAAATTCACT GTGAAAAAGGATAAGACAGAGAAGCCTGACACTGTCCAGCTACTCACTG TGAAGAAAGATGAAGGGGAGGGAGCAGCAGGGGCTGGCGACCACAAGG ACCCCAGCCTTGGGGCTGGAGAAGCAGCATCCAAAGAAAGCAGACCCAA ACAATCTACAGAGAAACCCGAAGAGACCCTGAAGCGTGAGCAAAGCCAC GCAGAAATTTCTCCCCCAGCCGAATCTGGCCAAGCAGTGGAGGAATGCA AAGAGGAAGGAGAAGAGAAACAAGAAAAAGAACCTAGCAAGTCTGCAG AATCTCCGACTAGTCCCGTGACCAGTGAAACAGGATCAACCTTCAAAAAA TTCTTCACTCAAGGTTGGGCCGGCTGGCGCAAAAAGACCAGTTTCAGGAA GCCGAAGGAGGATGAAGTGGAAGCTTCAGAGAAGAAAAAGGAACAAGA GCCAGAAAAAGTAGACACAGAAGAAGACGGAAAGGCAGAGGTTGCCTC CGAGAAACTGACCGCCTCCGAGCAAGCCCACCCACAGGAGCCGGCAGAA AGTGCCCACGAGCCCCGGTTATCAGCTGAATATGAGAAAGTTGAGCTGCC CTCAGAGGAGCAAGTCAGTGGCTCGCAGGGACCTTCTGAAGAGAAACCT GCTCCGTTGGCGACAGAAGTGTTTGATGAGAAAATAGAAGTCCACCAAG AAGAGGTTGTGGCCGAAGTCCACGTCAGCACCGTGGAGGAGAGAACCGA AGAGCAGAAAACGGAGGTGGAAGAAACAGCAGGGTCTGTGCCAGCTGA AGAATTGGTTGAAATGGATGCAGAACCTCAGGAAGCTGAACCTGCCAAG GAGCTGGTGAAGCTCAAAGAAACGTGTGTTTCCGGAGAGGACCCTACAC AGGGAGCTGACCTCAGTCCTGATGAGAAGGTGCTGTCCAAACCCCCGA AGGCGTTGTGAGTGAGGTGGAAATGCTGTCATCACAGGAGAGAATGAAG GTGCAGGGAAGTCCACTAAAGAAGCTTTTTACCAGCACTGGCTTAAAAAA GCTTTCTGGAAAGAAACAGAAAGGGAAAAGAGGAGGAGGAGACGAGGA ATCAGGGGAGCACACTCAGGTTCCAGCCGATTCTCCGGACAGCCAGGAG GAGCAAAAGGCGAGAGCTCTGCCTCATCCCCTGAGGAGCCCGAGGAGA TCACGTGTCTGGAAAAGGGCTTAGCCGAGGTGCAGCAGGATGGGGAAGC TGAAGAAGGAGCTACTTCCGATGGAGAGAAAAAAGAGAAGGTGTCACT CCCTGGGCATCATTCAAAAAGATGGTGACGCCCAAGAAGCGTGTTAGAC GGCCTTCGGAAAGTGATAAAGAAGATGAGCTGGACAAGGTCAAGAGCGC TACCTTGTCTTCCACCGAGAGCACAGCCTCTGAAATGCAAGAAGAAATGA AAGGGAGCGTGGAAGAGCCAAAGCCGGAAGAACAAAGCGCAAGGTGG ATACCTCAGTATCTTGGGAAGCTTTAATTTGTGTGGGATCATCCAAGAAA AGAAGCAAGGAGAGGGTCCTCTTCTGATGAGGAAGGGGGACCAAAGAGA TGGGAGGAGACCACCAGAAAGCTGATGAGGCCGAAAAGACAAAGAGA CGGGGACAGACGGGATCCTTGCTGGTTCCCAAGAACATGATCCAGGGCA GGGAAGTTCCTCCCCGGAGCAAGCTGGAAGCCCTACCGAAGGGGAGGGC GTTTCCACCTGGGAGTCATTTAAAAGGTTAGTCACGCCAAGAAAAAATC AAAGTCCAAGCTGGAAGAGAAAAGCGAAGACTCCATAGCTGGGTCTGGT | SEQ ID NO: 93 |

TABLE B-continued

| Gene Fusion | Chimera Sequence | SEQ ID NO. |
|---|---|---|
| | GTAGAACATTCCACTCCAGACACTGAACCCGGTAAAGAAGAATCCTGGG<br>TCTCAATCAAGAAGTTTATTCCTGGACGAAGGAAGAAAAGGCCAGATGG<br>GAAACAAGAACAAGCCCCTGTTGAAGACGCAGGGCAACAGGGGCCAAC<br>GAAGATGACTCTGATGTCCCGGCCGTGGTCCCTCTGTCTGAGTATGATGC<br>TGTAGAAAGGGAGAAAATGGAGGCACAGCAAGCCCAAAAAAGCGCAGA<br>GCAGCCCGAGCAGAAGGCAGCCACTGAGGTGTCCAAGGAGCTCAGCGAG<br>AGTCAGGTTCATATGATGGCAGCAGCTGTCGCTGACGGGACGAGGGCAG<br>CTACCATTATTGAAGAAAGGTCTCCTTCTTGGATATCTGCTTCAGTGACAG<br>AACCTCTTGAACAAGTAGAAGCTGAAGCCGCACTGTTAACTGAGGAGGT<br>ATTGGAAAGAAGTAATTGCAGAAGAAGAACCCCCCACGGTTACTGAA<br>CCTCTGCCAGAGAACAGAGAGGCCCGGGGCGACACGGTCGTTAGTGAGG<br>CGGAATTGACCCCCGAAGCTGTGACAGCTGCAGAAACTGCAGGGCCATT<br>GGGTGCCGAAGAAGGAACCGAAGCATCTGCTGCTGAAGAGACCACAGAA<br>ATGGTGTCAGCAGTCTCCCAGTTAACCGACTCCCCAGACACCACAGAGGA<br>GGCCACTCCGGTGCAGGAGGTGGAAGGTGGCGTACCTGACATAGAAGAG<br>CAAGAGAGGCGGACTCAAGAGGTCCTCCAGGCAGTGGCAGAAAAAGTGA<br>AAGAGGAATCCCAGCTGCCTGGCACCGGTGGGCCAGAAGATGTGCTTCA<br>GCCTGTGCAGAGAGCAGAGGCAGAAAGACCAGAAGAGCAGGCTGAAGC<br>GTCGGGTCTGAAGAAAGAGACGGATGTAGTGTTGAAAGTAGATGCTCAG<br>GAGGCAAAAACTGAGCCTTTTACACAAGGGAAGGTGGTGGGGCAGACCA<br>CCCCAGAAAGCTTTGAAAAAGCTCCTCAAGTCACAGAGAGCATAGAGTC<br>CAGTGAGCTTGTAACCACTTGTCAAGCCGAAACCTTAGCTGGGGTAAAAT<br>CACAGGAGATGGTGATGAACAGGCTATCCCCCCTGACTCGGTGGAAAC<br>CCCTACAGACAGTGAGACTGATGGAAGCACCCCCGTAGCCGACTTTGACG<br>CACCAGGCACAACCCAGAAAGACGAGATTGTGGAAATCCATGAGGAGAA<br>TGAGGTCGCATCTGGTACCCAGTCAGGGGGCACAGAAGCAGAGGCAGTT<br>CCTGCACAGAAAGAGAGGCCTCCAGCACCTTCCAGTTTTGTGTTCCAGGA<br>AGAAACTAAAGAACAATCAAAGATGGAAGACACTCTAGAGCATACAGAT<br>AAAGAGGTGTCAGTGGAAACTGTATCCATTCTGTCAAAGACTGAGGGGA<br>CTCAAGAGGCTGACCAGTATGCTGATGAGAAAACCAAAGACGTACCATT<br>TTTCGAAGGACTTGAGGGGTCTATAGACACAGGCATAACAGTCAGTCGG<br>GAAAAGGTCACTGAAGTTGCCCTTAAAGGTGAAGGGACAGAAGAAGCTG<br>AATGTAAAAAGGATGATGCTCTTGAACTGCAGAGTCACGCTAAGTCTCCT<br>CCATCCCCCGTGGAGAGAGAGATGGTAGTTCAAGTCGAAAGGGAGAAAA<br>CAGAAGCAGAGCCAACCCATGTGAATGAAGAGAAGCTTGAGCACGAAAC<br>AGCTGTTACCGTATCTGAAGAGGTCAGTAAGCAGCTCCTCCAGACAGTGA<br>ATGTGCCCATCATAGATGGGCAAAGGAAGTCAGCAGTTTGGAAGGAAG<br>CCCTCCTCCCTGCCTAGGTCAAGAGGAGGCAGTATGCACCAAAATTCAAG<br>TTCAGAGCTCTGAGGCATCATTCACTCTAACAGCGGCTGCAGAGGAGGAA<br>AAGGTCTTAGGAGAAACTGCCAACATTTTAGAAACAGGTGAAACGTTGG<br>AGCCTGCAGGTGCACATTTAGTTCTGGAAGAGAAATCCTCTGAAAAAAAT<br>GAAGACTTTGCCGCTCATCCAGGGGAAGATGCTGTGCCCACAGGGCCCG<br>ACTGTCAGGCAAAATCGACACCAGTGATAGTATCTGCTACTACCAAGAGA<br>GGCTTAAGTTCCGACCTGGAAGGAGAGAAAACCACATCACTGAAGTGGA<br>AGTCAGATGAAGTCGATGAGCAGGTTGCTTGCCAGGAGGTCAAAGTGAG<br>TGTAGCAATTGAGGATTTAGAGCCTGAAAATGGGATTTTGGAACTTGAGA<br>CCAAAAGCAGTAAACTTGTCCAAAACATCATCCAGACAGCCGTTGACCA<br>GTTTGTACGTACAGAAGAAACAGCCACCGAAATGTTGACGTCTGAGTTAC<br>AGACACAAGCTCACGTGATAAAAGCTGACAGCCAGGACGCTGGACAGGA<br>AACGGAGAAAGAAGGAGAGGAACCTCAGGCCTCTGCACAGGATGAAAC<br>ACCAATTACTTCAGCCAAAGAGGAGTCAGAGTCAACGCAGTGGGACAA<br>GCACATTCTGATATTTCCAAAGACATGAGTGAAGCCTCAGAAAAGACCAT<br>GACTGTTGAGGTAGAAGGTTCCACTGTAAATGATCAGCAGCTGGAAGAG<br>GTCGTCCTCCCATCTGAGGAAGAGGGAGGTGGAGCTGGAACAAAGTCTG<br>TGCCAGAAGATGATGGTCATGCCTTGTTAGCAGAAAGAATAGAGAAGTC<br>ACTAGTTGAACCGAAAGAAGATGAAAAAGGTGATGATGTTGATGACCCT<br>GAAAACCAGAACTCAGCCCTGGCTGATACTGATGCCTCAGGAGGCTTAAC<br>CAAAGAGTCCCCAGATACAAATGGACCAAAACAAAAGAGAAGGAGGA<br>TGCCCAGGAAGTAGAATTGCAGGAAGGAAAAGTGCACAGTGAATCAGAT<br>AAAGCGATCACACCCCAAGCACAGGAGGAGTTACAGAAACAAGAGAGA<br>GAATCTGCAAAGTCAGAACTTACAGAATCTTAA | |
| APPBP2-><br>KIF19 | ATGGCGGCCGTGGAACTAGAGTGGATCCCAGAGACTCTCTATAACACCGC<br>CATCTCCGCTGTCGTGGACAACTACATCCGCTCCCGCCGAGACATCCGCT<br>CCTTGCCCGAGAACATCCAGTTTGATGTTTACTACAAGCTTTACCAACAG<br>GGACGCTTATGTCAACTGGGCAGTGAATTTTGTGAATTGGAAGTTTTTGC<br>TAAAGTACTGAGAGCTTTGGATAAAAGGTGAAGCAGAACCTCCTGAACG<br>TCTCCTACCACATCGCCCAGTACACCAGCATCATCGCTGACCTGCGGGGC<br>GAGATCCAGCGACTCAAGCGCAAGATTGAGCAGACTGGGCGGGGCC<br>AGGCCCGGGGCCGGCAGGATCGGGTGACATCCGCCACATCCAAGCTGA<br>GGTCCAGCTGCACAGCGGGCAGGGTGAGAAGGCTGGCATGGGACAGCTT<br>CGGGAGCAGCTCGCCAGCGCCTTCCAGGAGCAGATGGATGTGCGAGGC<br>GCCTGCTGGAGCTGGAGAACGCGCCATGGAGGTCCAGATTGACACCTCC<br>GACACCTGCTCACCATCGCCGGCTGGAAGCATGAGAAGTCCCGCCGGG<br>CCCTCAAATGGCGGGAGGAGCAGCGAAAGGAGTGCTACGCTAAGGACGA<br>CAGCGAGAAGGACTCGAGACACAGGTGATGACCAACCAGACATCCTGGAG<br>CCACCCGAGGTGGCCGCAGCCCGGGAGAGCATTGCAGCCCTGGTGGACG | SEQ ID NO: 94 |

TABLE B-continued

| Gene Fusion | Chimera Sequence | SEQ ID NO. |
|---|---|---|
|  | AGCAGAAGCAACTGCGCAAGCAGAAGCTGGCGCTGGAGCAGCGCTGCCG GGAGCTGCGCGCGCGGGGCCGGCGCCTGGAGGAGACGCTGCCGCGGCGC ATCGGCTCCGAGGAGCAGCGCGAGGTGCTCAGCCTGCTGTGCCGCGTGCA CGAGCTCGAGGTGGAGAACACCGAGATGCAGTCGCACGCGCTGCTCCGC GACGGTGCGCTCCGCCACCGCCACGAGGCCGTGCGCCGCCTGGAGCAGC ACCGCAGTCTCTGCGACGAGATTATCCAGGGCCAGCGGCAGATCATCGAC GACTACAACCTGGCCGTCCCGCAGCGCCTGGAAGAGCTCTACGAAGTGTA CCTGCGGGAGCTGGAGGAGGGCAGCCTGGAGCAGGCCACCATCATGGAC CAAGTGGCCTCCAGGGCCCTGCAGGACAGCTCCTTGCCCAAAATTACCCC AGCAGGAACCTCACTGACCCCAGATTCTGACCTGGAGAGTGTGAAGACA TTGAGCTCTGATGCCCAGCACCTGCAGAACAGCGCCCTCCCTCCCCTCAG CACAGAGAGTGAAGGCCACCACGTGTTCAAGGCTGGTACTGGGGCCTGG CAGGCAAAAAGCTCCTCTGTGCCCACCCCACCTCCCATCCAGCTCGGCAG CCTGGTGACGCAGGAGGCCCCGGCTCAGGACAGCCTGGGCAGCTGGATC AACTCTTCCCCTGACAGCAGTGAGAACCTGTCGGAGATCCCCTTGTCCCA CAAAGAGAGGAAGGAGATCCTGACTGGCACCAAGTGCATCTGGGTGAAG GCCGCCCGGCGGCGCTCGCGGGCCCTGGGAACCGAGGGGCGACACCTGC TGGCACCCGCGACAGAGCGCAGCAGCCTGTCCCTGCACTCACTGAGCGA GGGCGACGATGCGCGGCCACCAGGCCCACTGGCCTGCAAGCGGCCGCCC AGCCCCACACTACAGCATGCTGCCAGTGAGGACAACCTGTCCAGCAGCA CGGGCGAGGCCCCGTCCCGGGCAGTCGGACATCATGGGGACGGCCCCAG GCCCTGGCTGCGTGGCCAGAAGAAAAGCCTGGGCAAGAAAAGGGAGGA GTCGCTGGAGGCAAAGAGAAGGAAGCGGAGGTCCCGATCCTTCGAGGTC ACCGGGCAAGGGCTCTCCCACCCCAAGACACACCTCCTGGGGCCCCATCA GGCGGAGCGCATCTCGGACCACAGGATGCCAGTGTGCAGGCACCCAGCC CCTGGTATCCGGCATCTGGGAAAGGTCACGCTACCTTTGGCCAAAGTCAA ACTCCCTCCAAGCCAGAAACACGGGCCGGGGGACTCCTCACCCCTGGCTG TTCCCCCCAACCCAGGTGGTGGTTCTCGACGGGCTACCCGTGGGCCCCGC CTGCCCCACGGCACAAGCACCCATGGCAAAGATGGATGCTCCCGGCATA ACTGA |  |
| ADAM9-><br>ANK1 | ATGGGGTCTGGCGCGCGCTTTCCCTCGGGGACCCTTCGTGTCCGGTGGTT GCTGTTGCTTGGCCTGGTGGGCCCAGTCCTCGGTGCGGCGCGGCCAGGCT TTCAACAGACCTCACATCTTTCTTCTTATGAAATTATAACTCCTTGGAGAT TAACTAGAGAAAGAAGAGAAGCCCCTAGGCCCTATTCAAAACAAGTATC TTATGTTATTCAGGCTGAAGGAAAAGAGCATATTATTCACTTGGAAAGGA ACAAAGACCTTTTGCCTGAAGATTTTGTGGTTTATACTTACAACAAGGAA GGGACTTTAATCACTGACCATCCCAATATACAGAATCATTGTCATTATCG GGGCTATGTGGAGGGAGTTCATAATTCATCCATTGCTCTTAGCGACTGTT TGGACTCAGAGGATTGCTGCATTTAGAGAATGCGAGTTATGGGATTGAAC CCCTGCAGAACAGCTCTCATTTTGAGCACATCATTTATCGAATGGATGAT GTCTACAAAGAGCCTCTGAAATGTGGAGTTTCCAACAAGGATATAGAGA AGAAACTGCAAAGGATGAAGAGGAAGAGCCTCCCAGCATGACTCAGCT ACTTCGAAGAAGAAGAGCTGTCTTGCCACAGACCCGGTATGTGGAGCTGT TCATTGTCGTAGACAAGGAAAGGTATGACATGATGGGAAGAAATCAGAC TGCTGTGAGAGAAGAGATGATTCTCCTGGCAAACTACTTGGATAGTATGT ATATTATGTTAAATATTCGAATTGTGCTAGTTGGACTGGAGATTTGGACC AATGGAAACCTGATCAACATAGTTGGGGGTGCTGGTGATGTGCGGGGA ACTTCGTGCAGTGGCGGGAAAAGTTTCTTATCACACGTCGGAGACATGAC AGTGCACAGCTAGTTCTAAAGAAAGGTTTTGGTGGAACTGCAGGAATGG CATTTGTGGGAACAGTGTGTTCAAGGAGCCACGCAGGCGGGATTAATGTG AAGGGGAACACGGCCCTGCACATCGCTGCTCTAGCCGGGCAGGATGAGG TGGTCCGGGAGCTTGTCAACTATGGAGCCAACGTCAACGCCCAGTCACAG AAAGGTTTTACACCCCTGTACATGGCAGCACAAGAGAACCACTTGGAAGT GGTTAAGTTTTTACTGGAAAATGGAGCTAACCAGAATGTAGCCACAGAA GACGGCTTCACGCCTCTGGCGGTAGCCCTGCAGCAGGGCCATGAGAACGT CGTCGCGCACCTCATCAACTACGGCACCAAGGGGAAGGTGCGCCTCCCG GCCCTGCACATCGCGGCCCGCAACGACGACACGCGCACGGCTGCGGTGC TGCTGCAGAACGACCCCAACCCGGACGTGCTTTCCAAGACGGGATTCACG CCCCTGCACATTGCGGCTCACTACGAGAACCTCAACGTGGCCCAGTTGCT CCTCAACAGAGGAGCCAGCGTCAATTTCACACCACAGAACGGCATCACG CCACTGCACATCGCCTCCCGCAGGGGCAACGTGATCATGGTGCGGCTGCT GCTGGATCGGGGAGCCCAGATAGAAACCAAGACCAAGGACGAATTGACA CCTCTCCACTGTGCAGCTCGAAATGGGCACGTGCGAATCTCAGAGATCCT GCTGGACCACGGGGCACCAATCCAAGCCAAAACCAAGAACGGCCTGTCC CCAATTCACATGGCGGCTCAGGGAGACCACCTCGACTGTGTCCGGCTCCT GTTGCAATACGACGCAGAGATAGACGACATCACCCTGGACCACCTGACC CCACTCCACGTGGCTGCCCACTGTGGACACCCACAGGGTGGCTAAGGTCCT TCTGGATAAAGGGGCCAAACCCAACTCCAGAGCCCTGAATGGCTTTACCC CCTTACACATCGCCTGCAAAAAGAACCACGTCCGTGTCATGGAGCTGCTG CTGAAGACGGGAGCCTCGATCGACGCGGTCACCGAGTCTGGCCTGACAC CTCTCCACGTGGCCTCCTTCATGGGGCACCTTCCCATCGTGAAGAACCTCC TGCAGCGGGGGCGTCGCCCAACGTCTCCAACGTGAAAGTGGAGACCCTC GCTACACATGGCAGCCAGAGCCGGGCACACGGAAGTGGCCAAATATTTA CTCCAGAACAAAGCCAAAGTCAATGCCAAGGCCAAGGATGACCAGACCC CACTTCACTGTGCAGCTCGCATCGGCCACACAAACATGGTGAAGCTCCTG CTGGAAAATAACGCCAACCCCAACCTGGCCACCACCGCCGGGCACACCCC | SEQ ID NO: 95 |

TABLE B-continued

| Gene Fusion | Chimera Sequence | SEQ ID NO. |
|---|---|---|
| | CCCTGCACATTGCAGCCCGTGAGGGCCATGTGGAAACAGTCCTGGCCCTT<br>CTGGAAAAGGAAGCATCCCAGGCCTGCATGACCAAGAAAGGATTTACCC<br>CTCTGCACGTGGCGGCCAAGTACGGGAAGGTGCGGGTGGCAGAGCTGCT<br>GCTGGAGCGGGACGCACACCCGAATGCTGCCGGAAAAAATGGCCTGACC<br>CCCCTGCACGTGGCCGTCCATCACAACAACCTGGACATCGTCAAGCTGCT<br>GCTTCCCCGGGGCGGCTCCCCGCACAGCCCTGCCTGGAATGGCTACACCC<br>CTTTGCACATCGCTGCCAAGCAGAACCAGGTGGAGGTGGCCCGTAGTCTG<br>CTGCAGTATGGGGGCTCAGCAAACGCCGAGTCGGTGCAAGGTGTGACGC<br>CCCTTCACCTGGCCGCCCAGGAGGGCCACGCAGAGATGGTGGCTCTGCTG<br>CTCTCGAAACAAGCCAATGGCAACCTGGGGAACAAGAGCGGACTCACTC<br>CCCTCCATCTGGTAGCACAAGAAGGCCACGTTCCAGTGGCAGATGTGCTG<br>ATCAAACACGGCGTCATGGTGGACGCCACCACCCGGATGGGCTACACTCC<br>CCTCCATGTGGCCAGTCACTATGGAAACATCAAGCTGGTGAAGTTTCTGC<br>TGCAGCACCAGGCAGATGTCAATGCCAAGACCAAGCTAGGATACAGCCC<br>CCTGCACCAGGCAGCCCAGCAGGGACACACAGACATCGTGACTCTGCTTC<br>TGAAAAACGGTGCTTCCCCAAACGAGGTCAGCTCGGATGGAACCACACC<br>TCTGGCCATAGCCAAGCGCTTGGGCTACATTTCTGTCACCGACGTGCTCA<br>AGGTCGTCACGGATGAAACCAGTTTCGTGTTAGTCAGTGATAAGCATCGA<br>ATGAGTTTCCCTGAGACAGTTGATGAGATCCTGGATGTCTCGGAAGATGA<br>AGGGGAAGAACTCATCAGCTTCAAGGCTGAGAGGCGGGATTCCAGGGAT<br>GTTGATGAAGAGAAGGAGCTGCTGGATTTTGTGCCGAAGCTAGACCAAG<br>TGGTGGAATCTCCAGCCATCCCCAGGATTCCCTGTGCCATGCCTGAGACA<br>GTGGTGATCAGGTCAGAAGAGCAGGAGCAGGCATCTAAAGAGTATGATG<br>AGGACTCCCTCATCCCCAGCAGCCCGGCCACCGAGACCTCAGACAACATC<br>AGCCCCGGTGGCCAGCCCGGTGCATACAGGGTTTCTGGTGAGCTTCATGGT<br>TGACGCCCGGGGTGGTTCCATGAGAGGAAGTCGCCACAACGGCCTGCGA<br>GTGGTGATCCCGCCACGGACGTGCGCAGCGCCCACCCGCATCACCTGCCG<br>CCTGGTCAAGCCCCAGAAGCTCAGCACGCCGCCCCCACTGGCCGAGGAG<br>GAGGGCCTGGCCAGCAGGATCATAGCACTGGGGCCCACGGGGCACAGT<br>TCCTGAGCCCTGTAATCGTGGAGATCCCGCACTTTGCCTCCCATGGCCGT<br>GGAGACCGCGAGCTCGTGGTTCTGAGGAGCGAAAACGGCTCCGTGTGGA<br>AGGAGCACAGGAGCCGCTATGGAGAGAGCTACCTGGATCAGATCCTCAA<br>CGGGATGGACGAAGAGCTGGGGAGCCTGGAGGAGCTAGAGAAGAAGAG<br>GGTGTGCCGAATCATCACCACCGACTTCCCGCTGTACTTCGTGATCATGTC<br>ACGGCTCTGCCAGGACTACGACACCATCGGTCCCGAAGGGGGCTCCCTGA<br>AGAGCAAGCTGGTGCCCCTGGTACAGGCAACGTTCCCGGAGAATGCCGT<br>CACCAAGAGAGTGAAGCTGGCTCTGCAGGCCCAGCCTGTCCCGGATGAG<br>CTTGTCACTAAGCTCCTGGGCAACCAGGCCACATTCAGCCCCATTGTCAC<br>CGTGGAGCCCCGGCGCCGGAAGTTCCACCGCCCATTGGGCTTCGGATCC<br>CACTACCTCCTTCCTGGACCGACAACCCGAGGGACAGCGGGGAGGGAGA<br>CACCACCAGCCTGCGCCTGCTTTGCAGCGTCATTGGAGGAACAGACCAAG<br>CCCAGTGGGAAGACATAACAGGAACCACCAAACTTGTATATGCCAACGA<br>GTGCGCCAACTTCACCACCAATGTCTCTGCCAGGTTTTGGCTGTCGGACT<br>GTCCTCGGACTGCTGAGGCTGTGAACTTTGCCACCCTGCTGTACAAAGAG<br>CTCACTGCAGTGCCCTACATGGCCAAATTCGTCATCTTTGCCAAGATGAA<br>TGACCCCCGAGAGGGGCGCCTGCGCTGCTACTGCATGACAGATGATAAA<br>GTGGACAAGACCCTGGAGCAGCATGAGAACTTCGTGGAGGTGGCCCGGA<br>GCAGGGACATAGAGGTGTTGAAGGAATGTCCCTGTTTGCAGAACTCTCT<br>GGGAACCTGGTGCCTGTGAAGAAAGCTGCCCAGCAGCGGAGCTTCCACTT<br>CCAGTCATTTCGGGAGAACCGTCTGGCCATGCCTGTAAAGGTGAGGGACA<br>GCAGTCGAGAGCCGGGAGGGTCCCTGTCGTTTCTGCGCAAGGCGATGAA<br>GTACGAGGACACCCAGCACATTTCTGCCACCTGAACATCACCATGCCCC<br>CCTGCGCCAAGGGAAGTGGAGCCGAAGATAGGAGAAGGACCCCGACGCC<br>CCTGGCCCTGCGATACAGCATTCTCAGTGAGTCCACACCAGGTTCTCTCA<br>GTGGGACAGAGCAGGCAGAGATGAAGATGGCTGTTATCTCAGAGCACCT<br>CGGTCTCAGCTGGGCAGAGTTGGCCCGGGAGCTGCAGTTCAGTGTGGAA<br>GACATCAACAGGATCCGAGTGGAAAATCCCAACTCCCTGTTGGAGCAGA<br>GTGTGGCCTTGCTGAACCTCTGGGTCATCCGTGAAGGCCAAAACGCAAAC<br>ATGGAGAATCTGTACACAGCCCTGCAGAGCATTGACGTGGCGGAGATCGT<br>GAACATGCTGGAGGGTTCCGGCCGACAGAGCCGCAACTTGAAGCCAGAC<br>AGGCGGCACACCGACCGCGACTACTCGCTGTCACCCTCCCAGATGAATGG<br>TTACTCCTCACTGCAGGACGAGCTGCTGTCCCCTGCCTCCCTGGGCTGTGC<br>ACTTTCCTCTCCGCTACGTGCAGACCAGTACTGGAATGAGGTGGCCGTCC<br>TAGACGCCATCCCCTTGGCGGCCACGGAGCATGACACCATGCTGGAGATG<br>TCTGACATGCAGGTGTGGTCTGCGGGCCTCACGCCTTCTCTGGTCACTGCT<br>GAGGACTCCTCTCTGGAGTGTAGCAAGGCTGAGGACTCTGATGCCACAGG<br>TCACAGAGTGGAAGTTGGAGGGGGCACTCTCAGAGGAACCGCGGGGCCCC<br>GAGTTGGGCTCTCTGGAACTTGTGGAGGACGACACAGTGGATTCAGATGC<br>CACAAATGGCCTTATCGATTTGCTTGAACAGGAGGAAGGTCAGAGGTCA<br>GAAGAGAAGCTGCCAGGTTCTAAGAGGCAGGATGACGCGACAGGTGCAG<br>GGCAGGACTCAGAGAATGAAGTGTCTCTTGTTTCAGGCCATCAGAGGGG<br>GCAAGCCCGAATCACACATTCCCCACCGTGAGTCAGGTGACGGAGAGG<br>AGTCAGGACAGACTGCAGGACTGGGATGCAGACGGCTCGATTGTCTCAT<br>ACCTGCAAGATGCTGCACAAGGTTCCTGGCAAGAGGAGGTCACGCAAGG<br>TCCACACTCATTCCAGGGAACAAGTACCATGACTGAAGGGCTAGAGCCC<br>GGTGGATCTCAGGAGTACGAGAAGGTCCTGGTGTCTGTAAGTGAGCACA<br>CGTGGACAGAACAGCCCGAGGCTGAGAGCTCCCAGGCCGACAGGGACCG | |

TABLE B-continued

| Gene Fusion | Chimera Sequence | SEQ ID NO. |
|---|---|---|
| | GAGGCAGCAAGGCCAAGAAGAGCAGGTGCAGGAGGCCAAGAACACCTT CACCCAAGTGGTGCAGGGGAATGAGTTTCAGAATATTCCAGGGGAGCAG GTGACAGAGGAGCAATTCACGGATGAGCAGGGCAACATTGTCACCAAGA AGATCATTCGCAAGGTGGTTCGACAGATAGACTTGTCCAGCGCCGATGCC GCCCAGGAGCACGAGGAGGTGGAGCTGAGAGGGAGTGGCCTACAGCCGG ACCTGATAGAGGGCAGGAAGGGGGCGCAGATAGTGAAGCGGGCCAGCCT GAAAAGGGGGAAACAGTGA | |
| MYO18A -> SSH2 | ATGTTTAACCTAATGAAGAAAGACAAGGACAAAGATGGCGGGCGGAAGG AGAAGAAGGAGAAAAAGGAGAAAAAGGAGCGGATGTCAGCGGCAGAGC TTCGGAGCCTGGAGGAGATGAGCCTGCGACGTGGCTTCTTCAACCTGAAC CGCTCCTCCAAGCGTGAATCCAAGACGCGCCTGGAAATCTCCAACCCCAT CCCCATCAAGGTGGCCAGCGGCTCTGACCTGCACCTGACTGACATTGACT CCGATAGTAACCGGGGCAGCGTCATCCTGGACTCGGGCCACCTAAGTACA GCCAGCTCCAGCGATGACCTCAAGGGTGAGGAGGGTAGCTTCCGTGGCTC GGTGCTGCAGCGGGCAGCCAAGTTCGGCTCACTGGCCAAGCAGAACTCA CAGATGATTGTCAAGCGCTTTTCCTTCTCCCAGCGTAGCGGGATGAGAG CGCCTCAGAAACCTCGACGCCCTCAGAGCACTCTGCCGCCCCCTCGCCAC AGGTGGAGGTGAGGACTCTAGAGGGACAGCTGGTGCAGCATCCTGGCCC AGGCATCCCTCGACCAGGGCACCGATCCCGAGCCCTGAGCTAGTGACTA AAAAGTTCCCAGTCGACCTGCGCCTGCCCCCCGTGGTGCCCCTGCCCCCA CCTACCCTCCGGGAGCTGGAGCTGCAACGACGGCCCACTGGAGACTTTGG CTTCTCCCTGCGCGCACAACCATGCTGGATCGGGCCCCGAGGGCCAGG CCTGTCGGCGTGTGGTCCACTTTGCTGAGCCTGGTGCAGGCACCAAGGAC CTGGCCCTGGGGCTGGTGCCAGGAGATCGACTGGTGGAGATTAATGGGC ACAATGTGGAGAGCAAGTCCAGGGATGAGATTGTGGAGATGATCCGGCA GTCAGGGGACAGCGTGCGGCTCAAGGTGCAGCCCATTCCAGAGCTCAGC GAGCTCAGCAGGAGCTGGCTGCGGAGCGGCGAGGGACCTCGCAGGGAGC CATCCGATGAGGCAGACAGTGGGGAGGAAGAATGCCGGTCACAGCCCAG GAGCATCAGCGAGAGCTTTCTAACTGTCAAAGGTGCTGCCCTTTTTCTAC CACGGGGAAATGGCTCATCCACACCAAGAATCAGCCACAGACGGAACAA GCATGCAGGCGATCTCCAACAGCATCTCCAAGCAATGTTCATTTTACTCC GCCCAGAAGACAACATCAGGCTGGCTGTAAGACTGGAAAGTACTTACCA GAATCGAACACGCTATATGGTAGTGGTTTCAACTAATGGTAGACAAGACA CTGAAGAAAGCATCGTCCTAGGAATGGATTTCTCCTCTAATGACAGTAGC ACTTGTACCATGGGCTTAGTTTTGCCTCTCTGGAGCGACACGCTAATTCAT TTGGATGGTGATGGTGGGTTCAGTGTATCGACGGATAACAGAGTTCACAT ATTCAAACCTGTATCTGTGCAGGCAATGTGGTCTGCACTACAGAGCTTAC ACAAGGCTTGTGAAGTCGCCAGAGCGCATAACTACTACCCAGGCAGCCT ATTTCTCACTTGGGTGAGTTATTATGAGAGCCATATCAACTCAGATCAAT CCTCAGTCAATAATGGAATGCAATGCAAGATGTACAGTCCCACCGGCCC GACTCTCCAGCTCTCTTCACCGACATACCTACTGAACGTGAACGAACAGA AAGGCTAATTAAAACCAAATTAAGGGAGATCATGATGCAGAAGGATTTG GAGAATATTACATCCAAAGAGATAAGAACAGAGTTGGAAATGCAAATGG TGTGCAACTTGCGGGAATTCAAGGAATTTATAGACAATGAAATGATAGTG ATCCTTGGTCAAATGGATAGCCCTACACAGATATTTGAGCATGTGTTCCT GGGCTCAGAATGGAATGCCTCCAACTTAGAGGACTTACAGAACCGAGGG GTACGGTATATCTTGAATGTCACTCGAGAGATAGATAACTTCTTCCCAGG AGTCTTTGAGTATCATAACATTCGGGTATATGATGAAGAGGCAACGGATC TCCTGGCGTACTGGAATGACACTTACAAATTCATCTCTAAAGCAAAGAAA CATGGATCTAAATGCCTTGTGCACTGCAAAATGGGGGTGAGTCGCTCAGC CTCCACCGTGATTGCCTATGCAATGAAGGAATATGGCTGGAATCTGGACC GAGCCTATGACTATGTGAAAGAAAGACGAACGGTAACCAAGCCCAACCC AAGCTTCATGAGACAACTGGAAGAGTATCAGGGGATCTTGCTGGCAAGC AAACAGCGGCATAACAAACTATGGAGATCTCATTCAGATAGTGACCTCTC AGACCACCACGAACCCATCTGCAAACCTGGGCTAGAACTCAACAAGAAG GATATCACCACCTCAGCAGACCAGATTGCTGAGGTGAAGACCATGGAGA GTCACCCACCCATACCTCCTGTCTTTGTGGAACATATGGTCCCACAAGAT GCAAATCAGAAAGGCCTGTGTACCAAAGAAAGAATGATCTGCTTGGAGT TTACTTCTAGGGAATTTCATGCTGGACAGATTGAGGATGAATTAAACTTA AATGACATCAATGGATGCTCATCAGGGTGTTGTCTGAATGAATCAAAATT TCCTCTTGACAATTGCCATGCATCCAAAGCCTTAATTCAGCCTGGACATGT CCCAGAAATGGCCAACAAGTTTCCAGACTTAACAGTGGAAGATTTGGAG ACAGATGCACTGAAAGCAGACATGAATGTCCACCTACTGCCTATGGAAG AATTGACATCTCCACTGAAAGACCCCCCCATGTCCCCTGATCCTGAGTCA CCAAGCCCCCAACCCAGTTGCCAGACTGAAATCTCAGATTTCAGTACAGA TCGCATTGACTTTTTTAGTGCCCTAGAGAAGTTTGTGGAGCTCTCCCAAGA AACCCGGTCACGATCTTTTTCCCATTCAAGGATGGAGGAACTGGGTGGAG GAAGGAATGAGAGCTGTCGACTGTCAGTGGTAGAAGTAGCCCCTTCCAA AGTGACAGCTGATGACCAGAGAAGCAGCTCTTTGAGTAATACTCCCCATG CATCAGAAGAATCTTCAATGGATGAGGAACAGTCAAAGGCAATTTCAGA ACTGGTCAGCCCAGACATCTTCATGCAGTCTCACTCGGAAATGCAATTT CAGTCAAAGAAATTGTCACTGAAATTGAGTCCATCAGTCAAGGAGTTGGG CAGATTCAACTGAAAGGAGACATCTTACCCAACCCATGCCATACACCAAA GAAGAACAGCATCCATGAGCTGCTCCTTGAGAGGGCCCAGACTCCAGAG AACAAACCTGGACATATGGAGCAAGATGAGGACTCCTGCACAGCCCAGC CTGAACTAGCCAAAGACTCAGGGATGTGCAACCCAGAAGGCTGCCTAAC | SEQ ID NO: 96 |

TABLE B-continued

| Gene Fusion | Chimera Sequence | SEQ ID NO. |
|---|---|---|
| | CACACACTCATCTATAGCAGACTTGGAAGAAGGGGAACCAGCTGAGGGG<br>GAACAAGAGCTCCAGGGCTCAGGGATGCACCCAGGTGCCAAGTGGTACC<br>CTGGGTCTGTGAGGCGAGCCACCTTGGAGTTCGAAGAGCGCTTACGGCAG<br>GAGCAAGAGCATCATGGTGCTGCCCCAACATGTACCTCATTGTCCACTCG<br>TAAGAATTCAAAGAATGATTCTTCTGTGGCAGACCTAGCACCAAAAGGG<br>AAAAGTGATGAAGCCCCCCAGAACATTCATTTGTCCTCAAGGAACCAGA<br>AATGAGCAAAGGCAAAGGGAAATACAGTGGGTCTGAGGCTGGCTCACTG<br>TCCCATTCTGAGCAGAATGCCACTGTTCCAGCTCCCAGGGTGCTGGAGTT<br>TGACCACTTGCCAGATCCTCAGGAGGGCCCAGGGTCAGATACTGGAACA<br>CAGCAGGAAGGAGTCCTGAAGGATCTGAGGACTGTGATTCCATACCAGG<br>AGTCTGAAACACAAGCAGTCCCTCTTCCCCTTCCCAAGAGGGTAGAAATC<br>ATTGAATATACCCACATAGTTACATCACCCAATCACACTGGGCAGGGAG<br>TGAAATAGCCACCAGTGAGAAGAGCGGAGAGCAAGGGCTGAGGAAAGT<br>GAACATGGAAAAATCTGTCACTGTGCTCTGCACACTGGATGAAAATCTAA<br>ACAGGACTCTGGACCCCAACCAGGTTTCTCTGCACCCCCAAGTGCTACCT<br>CTGCCTCATTCTTCCTCCCCTGAGCACAACAGACCCACTGACCATCCAAC<br>CTCCATCCTGAGTAGCCCTGAAGACAGAGGCAGCAGCCTGTCCACAGCCC<br>TGGAGACAGCAGCACCTTTTGTCAGTCATACAACCCATTTACTGTCTGCC<br>AGTTTGGATTACCTGCATCCCCAGACTATGGTTCACCTGGAGGGCTTCAC<br>AGAGCAGAGCAGCACTACAGATGAGCCCTCTGCAGAACAGGTTAGCTGG<br>GAAGAAAGTCAGGAGAGCCCTCTCTCCAGTGGCAGTGAGGTGCCATATA<br>AGGACTCCCAGCTAAGTAGCGCAGACCTAAGTTTAATTAGCAAACTTGGT<br>GACAACACTGGGGAGTTACAGGAGAAAATGGACCCATTGCCTGTAGCCT<br>GTCGACTCCCACATAGCTCTAGTAGTGAAAACATAAAGAGTCTCAGCCAC<br>AGCCCCGGTGTGGTGAAGGAGCGTGCTAAAGAAATCGAGTCTCGAGTGG<br>TTTTTCCAGGCAGGGCTCACCAAACCATCCCAAATGAGGCGCTCAGCTTCT<br>CTCGCCAAATTAGGTTACTTGGACCTCTGTAAAGACTGCTTACCAGAGAG<br>GGAGCCTGCCTCCTGTGAATCCCCTCATCTCAAACTGCTTCAGCCTTTCCT<br>CAGAACAGACTCAGGCATGCACGCGATGGAGGACCAAGAGTCCCTAGAA<br>AACCCAGGTGCCCCCCACAACCCAGAGCCCACCAAGTCTTTTGTAGAACA<br>ACTCACAACAACAGAGTGTATTGTGCAGAGCAAGCCAGTGGAGAGGCCC<br>CTTGTGCAGTATGCCAAAGAATTTGGTTCTAGTCAGCAGTATTTGCTCCCC<br>AGGGCAGGACTTGAATTGACTAGTTCTGAAGGAGGCCTTCCCGTGCTACA<br>GACCCAGGGACTGCAGTGTGCATGCCCAGCTCCAGGGCTGGCCGTGGCA<br>CCCCGTCAGCAACACGGCAGAACTCACCCCCTTAGGAGACTGAAAAAGG<br>CAAATGACAAAAAACGGACAACCAACCCCTTCTATAATACCATGTGA | |
| PLEKHA8 -> GNAQ | ATGGAGGGGGTGCTGTACAAGTGGACCAACTATCTGAGCGGTTGGCAGC<br>CTCGATGGTTCCTTCTCTGTGGGGAATATTGTCCTATTATGATTCTCCTG<br>AAGATGCCTGGAAAGGTTGCAAAGGGAGCATACAAATGGCAGTCTGTGA<br>AATTCAAGTTCATTCTGTAGATAATACACGCATGGACCTGATAATCCCTG<br>GGAACAGTATTTCTACCTGAAGGCCAGAAGTGTGGCTGAAAGACAGCG<br>GTGGCTGGTGGCCCTGGGATCAGCCAAGGCTTGCCTGACTGACAGTAGGA<br>CCCAGAAGGAGAAAGAGTTTGCTGAAAACACTGAAAACTTGAAAACCAA<br>AATGTCAGAACTAAGACTCTACTGTGACCTCCTTGTTCAGCAAGTAGATA<br>AAACAAAAGAAGTGACCACAACTGGTGTGTCCAATTCTGAGGAGGGAAT<br>TGATGTGGGAACTTTTGCTGAAATCAACCTGTAATACTTTTCTGAAGACCTT<br>GGAAGAATGCATGCAGATCGCAAATGCAGCCTTCACCTCTGAGCTGCTCT<br>ACCGCACTCCACCAGGATCACCTCAGCTGGCCATGCTCAAGTCCAGCAAG<br>ATGAAACATCCTATTATACCAATTCATAATTCATTGGAAAGGCAAATGGA<br>GTTGAGCACTTGTGAAAATGGATCTTTAAATATGGAAATAAATGGTGAGG<br>AAGAAATCCTAATGAAAAATAAGAATTCCTTATATTTGAAATCTGCAGAG<br>ATAGACTGCAGCATATCAAGTGAGGAAAATACAGATGATAATATAACAG<br>TCCAAGGTGAAATAAGGAAGGAAGATGGAATGGAAACCTGAAAAATCA<br>TGACAATAACTTGACTCAGTCTGGATCAGACTCAAGTTGCTCTCCGGAAT<br>GCCTCTGGGAGGAAGGCAAAGAAGTTATCCCAACTTTCTTTAGTACCATG<br>AACACAAGCTTTAGTGACATTGAACTTCTGGAAGACAGTGGCATTCCCAC<br>AGAAGCATTCTTGGCATCATGTTATGCTGTGGTTCCAGTATTAGACAAAC<br>TTGGCCCTACAGTGTTTGCTCCTGTTAAGATGGATCTTGTTGGAAATATTA<br>AGAAAGTAAATCAGAAGTATATAACCAACAAAGAAGAGTTTACCACTCT<br>CCAGAAGATAGTGCTGCACGAAGTGGAGGCGGATGTAGCCCAGGTTAGG<br>AACTCAGCGACTGAAGCCCTCTTGTGGCTGAAGAGAGGTCTCAAATTTTT<br>GAAGGGATTTTTGACAGAAGTGAAAAATGGGAGAAGGATATCCAGACA<br>GCCCTAAATAATGCATATGGTAAAACATTGCGGCAACACCATGGCTGGGT<br>AGTTCGAGGGGTTTTTGCGGGACAGGAGAGAGTGGCAAGAGTACGTTTA<br>TCAAGCAGATGAGAATCATCCATGGGTCAGGATACTCTGATGAAGATAA<br>AAGGGGCTTCACCAAGCTGGTGTATCAGAACATCTTCACGGCCATGCAGG<br>CCATGATCAGAGCCATGGACACACTCAAGATCCCATACAAGTATGAGCA<br>CAATAAGGCTCATGCACAATTAGTTCGAGAAGTTGATGTGGAGAAGGTGT<br>CTGCTTTTGAGAATCCATATGTAGATGCAATAAAGAGTTTATGGAATGAT<br>CCTGGAATCCAGGAATGCTATGATAGACGACGAGAATATCAATTATCTGA<br>CTCTACCAAATACTATTTAATGACTTGGACCGCGTAGCTGACCCTGCCT<br>ACCTGCCTACGCAACAAGATGTGCTTAGAGTTCGAGTCCCCACCACAGGG<br>ATCATCGAATACCCCTTTGACTTACAAAGTGTCATTTTCAGAATGGTCGAT<br>GTAGGGGGCCAAAGGTCAGAGAGAAGAAAATGGATACACTGCTTTGAAA<br>ATGTCACCTCTATCATGTTTCTAGTAGCGCTTAGTGAATATGATCAAGTTC<br>TCGTGGAGTCAGACAATGAGAACCGAATGGAGGAAAGCAAGGCTCTCTT | SEQ ID NO: 97 |

TABLE B-continued

| Gene Fusion | Chimera Sequence | SEQ ID NO. |
|---|---|---|
| | TAGAACAATTATCACATACCCCTGGTTCCAGAACTCCTCGGTTATTCTGTT CTTAAACAAGAAAGATCTTCTAGAGGAGAAAATCATGTATTCCCATCTAG TCGACTACTTCCCAGAATATGATGGACCCCAGAGAGATGCCCAGGCAGCC CGAGAATTCATTCTGAAGATGTTCGTGGACCTGAACCCAGACAGTGACAA AATTATCTACTCCCACTTCACGTGCGCCACAGACACCGAGAATATCCGCT TTGTCTTTGCTGCCGTCAAGGACACCATCCTCCAGTTGAACCTGAAGGAG TACAATCTGGTCTAA | |
| FBXL20-> NSF | ATGAGGAGGGACGTGAACGGAGTGACCAAGAGCAGGTTTGAGATGTTCT CAAATAGTGATGAAGCTGTAATCAATAAAAAACTTCCCAAAGAACTCCTG TTACGGATATTTTCTTTTCTAGATGTTGTTACCCTGTGCCGCTGTGCTCAG GTCTCCAGGGCCTGGAATGTTCTGGCTCTGGATGGCAGTAACTGGCAGCG AATTGACCTATTTGATTTCCAGAGGGATATTGAGGGCCGAGTAGTGGAGA ATATTTCAAAACGATGTGGGGGCTTTTTACGAAAGTTAAGTCTTCGTGGA TGTCTTGGAGTGGGAGACAATGCATTAAGAACCTTTGCACAAAACTGCAG GAACATTGAAGTACTGAATCTAAATGGGTGTACAAAGACAACAGACGCG TTGTAAACATGTTAAAGGCATCCTGTTATATGGACCCCCAGGTTGTGGTA AGACTCTCTTGGCTCGACAGATTGGCAAGATGTTGAATGCAAGAGAGCCC AAAGTGGTCAATGGGCCAGAAATCCTTAACAAATATGTGGGAGAATCAG AGGCTAACATTCGCAAACTTTTTGCTGATGCTGAAGAGGAGCAAAGGAG GCTTGGTGCTAACAGTGGTTTGCACATCATCATCTTTGATGAAATTGATGC CATCTGCAAGCAGAGAGGGAGCATGGCTGGTAGCACGGGAGTTCATGAC ACTGTTGTCAACCAGTTGCTGTCCAAAATTGATGGCGTGGAGCAGCTAAA CAACATCCTAGTCATTGGAATGACCAATAGACCAGATCTGATAGATGAGG CTCTTCTTAGACCTGGAAGACTGGAAGTTAAAATGGAGATAGGCTTGCCA GATGAGAAAGGCCGACTACAGATTCTTCACATCCACACAGCAAGAATGA GAGGGCATCAGTTACTCTCTGCTGATGTAGACATTAAAGAACTGGCCGTG GAGACCAAGAATTTCAGTGGTGCTGAATTGGAGGGTCTGGTGCGAGCAG CCCAGTCCACTGCTATGAATAGACACATAAAGGCCAGTACTAAAGTGGA AGTGGACATGGAGAAAGCAGAAAGCCTGCAAGTGACGAGAGGAGACTTC CTTGCTTCTTTGGAGAATGATATCAAACCAGCCTTTGGCACAAACCAAGA AGATTATGCAAGTTACATTATGAACGGTATCATCAAATGGGGTGACCCAG TTACTCGAGTTCTAGATGATGGGGAGCTGCTGGTGCAGCAGACTAAGAAC AGTGACCGCACACCATTGGTCAGCGTGCTTCTGGAAGGCCCTCCTCACAG TGGGAAGACTGCTTTAGCTGCAAAAATTGCAGAGGAATCCAACTTCCCGT TCATCAAGATCTGTTCTCCTGATAAAATGATTGGCTTTTCTGAAACAGCCA AATGTCAGGCCATGAAGAAGATCTTTGATGATGCGTACAAATCCCAGCTC AGTTGTGTGGTTGTGGATGACATTGAGAGATTGCTTGATTACGTCCCTATT GGCCCTCGATTTTCAAATCTTGTATTACAGGCTCTTCTCGTTTTACTGAAA AAGGCACCTCCTCAGGGCCGCAAGCTTCTTATCATTGGGACCACTAGCCG CAAAGATGTCCTTCAGGAGATGGAAATGCTTAACGCTTTCAGCACCACCA TCCACGTGCCCAACATTGCCACAGGAGCAGCTGTTGGAAGCTTTGGAG CTTTTTGGGCAACTTCAAGGATAAGGAACGCACCACAATTGCACAGCAAGT CAAAGGGAAGAAGGTCTGGATAGGAATCAAGAAGTTACTAATGCTGATC GAGATGTCCCTACAGATGGATCCTGAATACCGTGTGAGAAAATTCTTGGC CCTCTTAAGAGAAGAAGGAGCTAGCCCCCTTGATTTTGATTGA | SEQ ID NO: 98 |
| TRIM37-> BCAS3 | ATGGATGAACAGAGCGTGGAGAGCATTGCTGAGGTTTTCCGATGTTTCAT TTGTATGGAGAAATTGCGGGATGCACGCCTGTGTCCTCATTGCTCCAAAC TGTGTTGTTTCAGCTGTATTAGGCGCTGGCTGACAGAGCAGAGAGCTCAA TGTCCTCATTGCCGTGCTCCACTCCAGCTACGAGAACTAGTAAATTGTCGT TGGGCAGAAGAAGTAACACAACAGCTTGATACTCTTCAACTCTGCAGTCT CACCAAACATGAAGAAATGAAAAGGACAAATGTGAAAATCACCATGAA AAACTTAGTGTATTTTGCTGGACTTGTAAGAAGTGTATCTGCCATCAGTGT GCACTTTGGGGAGGAATGCATGGCGGACATACCTTTAAACCTTTGGCAGA AATTTATGAGCAACACGTCACTAAAGTGAATGAAGAGGTAGCCAAACTT CGTCGGCGTCTCATGGAACTGATCAGCTTAGTTCAAGAAGTGGAAAGGA ATGTAGAAGCTGTAAGAAATGCAAAAGATGAGCGTGTTCGGGAAATTAG GAATGCAGTGGAGATGATGATTGCACGGTTAGACACACAGCTGAAGAAT AAGCTTATAACACTGATGGGTCAGAAGACATCTCTAACCCAAGAAACAG AGCTTTTGGAATCCTTACTTCAGGAGGTGGAGCACCAGTTGCGGTCTTGT AGTAAGAGTGAGTTGATATCTAAGAGCTCAGAGATCCTTATGATGTTTCA GCAAGTTCATCGGAAGCCCATGGCATCTTTTGTTACCACTCCTGTTCCACC AGACTTTACCAGTGAATTAGTGCCATCTTACGATTCAGCTACTTTTGTTTT AGAGAATTTCAGCACTTTGCGTCAGAGAGCAGATCCTGTTTACAGTCCAC CTCTTCAAGTTTCAGGACTTTGCTGGAGGTTAAAAGTTTACCCAGATGGA AATGGAGTTGTGCGAGGTTACTACTTATCTGTGTTTCTGGAGCTCTCAGCT GGCTTGCCTGAAACTTCTAAATATGAATATCGTGTAGAGATGGTTCACCA GTCCTGTAATGATCCTACAAAAAATATCATTCGAGAATTTGCATCTGACT TTGAAGTTGGAGAATGCTGGGCTATAATAGATTTTTCCGTTTGGACTTA CTCGCAAATGAAGGATACTTGAATCCACAAAATGATACAGTGATTTTAAG GTTTCAGGTACGTTCACCAACTTTCTTTCAAAAATCCCGGGACCAGCATT GGTACATTACTCAGTTGGAAGCTGCACAGACTAGTTATATCCAACAAATA AACAACCTTAAAGAGAGACTTACTATTGAGCTGTCTCGAACTCAGAAGTC AAGAGATTTGTCACCACCAGATAACCATCTTAGCCCCCAAAATGATGATG CTCTGGAGACACGAGCTAAGAAGTCTGCATGCTCTGACATGCTTCTCGAA GGTGGTCCTACTACAGCTTCTGTAAGAGAGGCCAAAGAGGATGAAGAAG | SEQ ID NO: 99 |

TABLE B-continued

| Gene Fusion | Chimera Sequence | SEQ ID NO. |
|---|---|---|
| | ATGAGGAGAAGATTCAGAATGAAGATTATCATCACGAGCTTTCAGATGG<br>AGATCTGGATCTGGATCTTGTTTATGAGGATGAAGTAAATCAGCTCGATG<br>GCAGCAGTTCCTCTGCTAGTTCCACAGCAACAAGTAATACAGAAGAAAT<br>GATATTGATGAAGAAACTATGTCTGGAGAAATGATGTGGAATATAACA<br>ACATGGAATTAGAAGAGGGAGAACTCATGGAAGATGCAGCTGCTGCAGG<br>ACCCGCAGGTAGTAGCCATGGTTATGTGGGTTCCAGTAGTAGAATATCAA<br>GAAGAACACATTTATGCTCCGCTGCTACCAGTAGTTTACTAGACATTGAT<br>CCATTAATTTTAATACATTTGTTGGACCTTAAGGACCGGAGCAGTATAGA<br>AAATTTGTGGGGCTTACAGCCTCGCCCACCTGCTTCACTTCTGCAGCCCAC<br>AGCATCATATTCTCGAAAAGATAAAGACCAAAGGAAGCAACAGGCAATG<br>TGGCGAGTGCCCTCTGATTTAAAGATGCTAAAAAGACTCAAAACTCAAAT<br>GGCCGAAGTTCGATGTATGAAAACTGATGTAAAGAATACACTTTCAGAA<br>ATAAAAAGCAGCAGTGCTGCTTCTGGAGACATGCAGACAAGCCTTTTTTC<br>TGCTGACCAGGCAGCTCTGGCTGCATGTGGAACTGAAAACTCTGGCAGAT<br>GCAGGATTTGGGAATGGAACTCCTGGCAAAGTCATCAGTTGCCAATTGT<br>TACATACGAAACTCCACAAATAAGAAGAGTAATTCGCCCAAGCCAGCTC<br>GATCCAGTGTAGCAGGTAGTCTATCACTTCGAAGAGCAGTGGACCCTGGA<br>GAAAATAGTCGTTCAAAGGGAGACTGTCAGACTCTGTCTGAAGATACATC<br>AAGAAATCTGGAATTTCATGAAATACATAGTACTGGGAATGAACCGCCTT<br>TGTTGATTATGATTGGCTACAGTGATGGAATGCAGGTCTGGAGCATCCCT<br>ATCAGTGGTGAAGCACAAGAGCTCTTCTCTGTTCGACATGGCCCAATTCG<br>AGCGGCTAGAATCTTGCCTGCTCCACAGTTTGGTGCTCAAAAATGTGATA<br>ACTTTGCTGAAAAAAGACCCCTCCTTGGTGTTTGTAAGAGCATTGGATCT<br>TCTGGCACAAGCCCACCGTACTGTTGTGTGGATCTGTATTCACTTCGTACT<br>GGGGAGATGGTCAAGTCCATTCAATTTAAGACACCTATTTATGATCTCCA<br>TTGCAATAAACGGATCCTTGTCGTAGTCTTGCAGGAGAAAATTGCTGCCT<br>TTGATAGCTGTACTTTCACGAAGAAATTCTTTGTTACAAGCTGCTATCCAT<br>GTCCAGGGCCAAACATGAATCCTATTGCTCTTGGGAGCCGCTGGCTTGCT<br>TATGCAGAAAACAAGTTGATTCGATGTCATCAGTCCCGTGGTGGAGCCTG<br>TGGAGACAACATTCAGTCTTATACTGCCACAGTCATTAGTGCTGCTAAAA<br>CATTGAAAAGTGGCCTGACAATGGTAGGGAAAGTGGTGACTCAGCTGAC<br>AGGCACACTGCCTTCAGGTGTGACAGAAGATGATGTTGCCATCCACAGTA<br>ATTCACGGCGGAGTCCTTTGGTCCCAGGCATCATCACAGTTATTGACACC<br>GAAACCGTTGGAGAGGGCCAGGTGCTTGTGAGTGAGGATTCTGACAGTG<br>ATGGCATTGTGGCCCACTTCCCTGCCCATGAGAAGCCAGTGTGCTGCATG<br>GCTTTTAATCAAGTGGAATGCTTCTAGTCACAACAGACACCCTTGGCCA<br>TGACTTTCATGTCTTCCAAATTCTGACTCATCCTTGGTCCTCATCACAATG<br>TGCTGTCCACCATCTGTATACTCTTCACAGGGGAGAAACTGAAGCCAAAG<br>TACAGGACATCTGCTTCAGCCATGACTGTCGCTGGGTTGTGGTCAGTACT<br>CTCCGGGGTACTTCCCACGTTTTCCCCATCAACCCTTATGGTGGCCAGCCT<br>TGTGTTCGTACACATATGTCACCACGAGTAGTGAATCGCATGAGCCGTTT<br>CCAGAAAAGTGCTGGACTGGAAGAGATTGAACAAGAACTGACGTCTAAG<br>CAAGGAGGTCGCTGTAGCCCTGTTCCAGGTCTATCAAGCAGCCCTTCTGG<br>GTCACCCTTGCATGGGAAACTGAACAGCCAAGACTCCTATAACAATTTTA<br>CCAACAACAACCCTGGCAACCCTCGGCTCTCTCCTCTTCCCAGCTTGATG<br>GTAGTGATGCCTCTTGCACAAATCAAGCAGCCAATGACATTGGGGACCAT<br>CACCAAACGAACCGGCAAAGTTAAACCTCCTCCACAAATTTCACCCAGCA<br>AATCGATGGGCGGAGAATTTTGTGTGGCTGCTATCTTCGGAACATCCAGG<br>TCATGGTTTGCAAATAATGCAGGTCTGAAAAGAGAAAAAGATCAGTCCA<br>AACAAGTTGTAGTTGAGTCCCTGTACATTATCAGTTGCTATGGCACCTTA<br>GTGGAACACATGATGGAGCCGCGACCCCTCAGCACTGCACCCAAGATTA<br>GTGACGACACACCACTGGAAATGATGACATCGCCTCGAGCCAGCTGGAC<br>TCTGGTTAGAACCCCTCAATGGAATGAATTGCAGCCACCGTTTAATGCAA<br>ACCACCCTCTGCTCCTCGCTGCAGATGCAGTACAGTATTATCAGTTCCTGC<br>TTGCTGGCCTGGTTCCCCCTGGAAGTCCTGGGCCCATTACTCGACATGGG<br>TCTTACGACAGTTTAGCTTCTGACCATAGTGGACAGGAAGATGAAGAATG<br>GCTTTCCCAGGTTGAAATTGTAACACACACTGGACCCCATAGACGTCTGT<br>GGATGGGTCCACAGTTCCAGTTCAAAACCATCCATCCCTCAGGCCAAACC<br>ACAGTTATCTCATCCAGTTCATCTGTGTTGCAGTCTCATGGTCCGAGTGAC<br>ACGCCACAGCCTCTTTTGGATTTTGATACAGATGATCTTGATCTCAACAGT<br>CTCAGGATCCAGCCAGTCCGCTCTGACCCCGTCAGCATGCCAGGGTCATC<br>CCGTCCAGTCTCTGATCGAAGGGAGTTTCCACAGTGATTGATGCTGCCT<br>CAGGTACCTTTGACAGGAGCGTGACCCTGCTGGAGGTGTGCGGGAGCTG<br>GCCTGAGGGCTTCGGGCTGCGGCACATGTCCTCCATGGAGCACACGGAG<br>GAGGGCCTCCGGGAGCGACTTGCCGACGCCATGGCCGAGTCACCTAGCC<br>GGGACGTCGTGGGATCCGAACAGACTTCAGCGAGAGGGAAGCATCGA<br>GACTCTGAGTAACAGCTCAGGCTCCACCAGCGGCAGCATACCAAGAAAC<br>TTTGATGGCTACCGATCTCCGCTGCCCACCAATGAGAGCCAGCCCCTCAG<br>CCTCTTCCCGACTGGCTTCCCGTAG | |
| ZBTB46-><br>DNAJC5 | ATGAACAACCGAAAGGAAGATATGGAAATCACGTCCCACTACCGGCACC<br>TGCTGCGGGAGCTCAACGAGCAGAGGCAGCACGGCGTCCTGTGCGACGT<br>CTGCGCTGGTCGTGGAGGGCAAGGTCTTCAAGGCGCACAAGAACGTCCTG<br>CTGGGCAGCAGCCGCTACTTCAAGACGCTCTACTGCCAGGTGCAGAAGAC<br>GTCGGAGCAGGCCACGGTCACGCACCTGGACATCGTCACGGCCCAGGGC<br>TTCAAGGCCATCATCGACTTCATGTACTCAGCGCACCTGGCGCTCACCAG<br>CAGGAACGTCATCGAGGTGATGTCAGCCGCCAGCTTCCTGCAGATGACGG | SEQ ID NO: 100 |

TABLE B-continued

| Gene Fusion | Chimera Sequence | SEQ ID NO. |
|---|---|---|
| | ACATCGTGCAAGCCTGCCACGACTTCATCAAGGCGGCGCTGGACATCAGC<br>ATCAAGTCGGACGCCTCAGATGAGCTTGCGGAGTTCGAGATCGGCGCCTC<br>GTCCAGCAGCAGCACGGAAGCTCTCATCTCGGCCGTGATGGCTGGGAGG<br>AGCATCTCCCCGTGGCTGGCACGGCGAACGAGTCCTGCCAATTCTTCCGG<br>AGACTCGGCCATCGCCAGCTGTCACGACGGAGGGAGCAGCTACGGGAAA<br>GAGGATCAGGAGCCCAAGGCCGATGGCCCTGATGATGTTTCTTCACAGCC<br>TCTATGGCCTGGAGACGTGGGCTACGGGCCTCTGCGCATCAAGGAAGAG<br>CAGGTTTCACCGTCTCAGTACGGAGGGAGCGAGCTGCCTTCTGCCAAGGA<br>CGGTGCAGTACAGAACTCTTTCTCAGAGCAGAGTGCTGGTGATGCCTGGC<br>AGCCCACGGGCCGAAGGAAGAATCGGAAAAACAAAGAGACCGTCCGGC<br>ACATCACACAGCAGGTGGAAGATGACAGCCGGGCCAGCTCCCCGGTGCC<br>GTCCTTCCTGCCGACGTCGGGGTGGCCGTTCAGCAGCCGAGACTCAAATG<br>GCAGACCAGAGACAGCGCTCACTGTCTACCTCTGGGGAGTCATTGTACCA<br>CGTCCTTGGGTTGGACAAGAACGCAACCTCAGATGACATTAAAAAGTCCT<br>ATCCGAAGCTTGCCTTGAAATATCACCCCGACAAGAACCCCGACAACCCG<br>GAGGCCGCGGACAAGTTTAAGGAGATCAACAACGCGCACGCCATCCTCA<br>CGGACGCCACAAAAAGGAACATCTACGACAAGTACGGCTCGCTGGGTCT<br>CTACGTGGCCGAGCAGTTTGGGGAAGAGAACGTGAACACCTACTTCGTGC<br>TGTCCAGCTGGTGGGCCAAGGCCCTGTTTGTCTTCTGCGGCCTCCTCACGT<br>GCTGCTACTGCTGCTGCTGTCTGTGCTGCTTCAACTGCTGCTGCGGGA<br>AGTGTAAGCCCAAGGCGCCTGAAGGCGAGGAGACGGAGTTCTACGTGTC<br>CCCCGAGGATCTGGAGGCACAGCTGCAGTCTGACGAGAGGGAGGCCACA<br>GACACGCCGATCGTCATACAGCCGGCATCCGCCACCGAGACCACCCAGCT<br>CACAGCCGACTCCCACCCCAGCTACCACACTGACGGGTTCAACTAA | |

TABLE C

| Fusion genes | Fusion junction | Primer design method | Amplicon length (bp) | Forward primer | SEQ ID NO: | Probe | SEQ ID NO: | Reverse primer | SEQ ID NO: | Amplicon | SEQ ID NO: |
|---|---|---|---|---|---|---|---|---|---|---|---|
| ABI1->PDSS1# | -chr10: 27149676-> +chr10: 27024169 | Manual | 88 | GCAGACT ACTGTGA AAACAACT | 101 | ACATA CAGGT CTCTGT TCTAG GATGT CCCG | 102 | TTCCGT ACTGA TAGGC GAT | 103 | GCAGACTACTGT GAAAACAACTAC ATACAGGTCTCT GTTCTAGGATGT CCCGACCCAGTG GTGCATGAGATC GCCTATCAGTAC GGAA | 104 |
| ACACA->MSI2 | -chr17: 35536201-> +chr17: 55478740 | Primer3 | 76 | TCCACAT GAACAG GCTTCC | 105 | TTGTTC TTGTG ACCAT CTCATT TCCTCC | 106 | GCAGA TAACC CGCCT ACAA | 107 | TCCACATGAACA GGCTTCCAGGAG GAAATGAGATGG TCACAAGAACAA AGAAAATATTTG TAGGCGGGTTAT CTGC | 108 |
| ADK->C10orf11 | +chr10: 75984349-> +chr10: 77795766 | Primer3 | 73 | TGACCAA ATCTTGG CTGAAG | 109 | CAGTC CTTCC AGTGA CAGTT CCTTGTG | 110 | CTCCA GGCTC CTGAA TGC | 111 | TGACCAAATCTT GGCTGAAGACAA ACACAAGGAACT GTCACTGGAAGG ACTGAGCGCATT CAGGAGCCTGGAG | 112 |
| ARNT2->MESDC2 | +chr15: 80750317->-chr15: 81274523 | Primer3 | 85 | GGACTTC GATGATG AAGATGG | 113 | TCTTTC TTGAA AATTT ACTGG GGCCT TCA | 114 | TGTGC TCTGG AAGAT CTCCTT | 115 | GGACTTCGATGA TGAAGATGGTGA AGGCCCCAGTAA ATTTTCAAGAAA GATGATGACATT GAAGAAGGAGAT CTTCCAGAGCACA | 116 |
| ATRX->RPS6KA6 | -chrX: 76907604 ->-chrX: 83419395 | Manual | 79 | AAACGTA TTGCTGA GAGGGA | 117 | ACCAT TTACCT CTCTC AATTTT TCTCG CTCAC GC | 118 | CCATT GGCTC ATCAA CCATTT TAA | 119 | AAACGTATTGCT GAGAGGGAGCGT GAGCGAGAAAAA TTGAGAGGGTA AATGGTCTTAAA ATGGTTGATGAG CCAATGG | 120 |

TABLE C-continued

| Fusion genes | Fusion junction | Primer design method | Amplicon length (bp) | Forward primer | SEQ ID NO: | Probe | SEQ ID NO: | Reverse primer | SEQ ID NO: | Amplicon | SEQ ID NO: |
|---|---|---|---|---|---|---|---|---|---|---|---|
| BCL7A->C12orf42 | +chr12: 122473333->-chr12: 103872225 | Manual | 85 | AACAGTTCCTCCCCAGGGA | 121 | TTGACAAGTTCAACTCCCATGCATGTCCATC | 122 | CCTTTGTTTCATACATATCACTGTAGAC | 123 | AACAGTTCCTCCCCAGGGATGATGGACATGCATGGGAGTTGAACTTGTCAAATTAATGTCTACAGTGATATGTATGAAACAAAGG | 124 |
| CDC42BPB->PET112 | -chr14: 103523336->-chr4: 152594048 | Manual | 75 | CCTGCGCCGCGACAAGTA | 125 | CCTCAAACACCCCACTCGAGGAACTCGGCC | 126 | TCTTGCCTTCCCTCTTCCACAG | 127 | CCTGCGCCGCGACAAGTACGTGGCCGAGTTCCTCGAGTGGGGTGTTTGAGGAACTGTGGAAGAGGGAAGGCAAGA | 128 |
| CLEC16A->BCAR4 | +chr16: 1154879->-chr16: 11914154 | Primer3 | 76 | CTGACTCGGGAGGAGGAC | 129 | TGTCAGATCCAGGACATCATCAGTCTTG | 130 | GATAGGTTGGTACATGGTGATTTT | 131 | CTGACTCGGGAGGAGGACCTGATCAAGACTGATGATGTCCTGGATCTGACAAAAAATCACCATGTACCAACCTATC | 132 |
| CLTB->CDHR2 | -chr5: 175837258->+chr5: 175995679 | Primer3 | 82 | ACATGGGGACCACAGTCAA | 133 | CTGGGCACCTGAAACACATCTCCA | 134 | AGGGTCATTGTCCTGGTCTT | 135 | ACATGGGGACCACAGTCAATGGAGATGTGTTTCAGGTGCCCAGGCCTTCTGGTTGGTAGCGGAAGACCAGGACAATGACCCT | 136 |
| CREB1->TMEM131 | +chr2: 208435045->-chr2: 98543950 | Manual | 77 | GGTGCCAACTCCAATTTACCAAA | 137 | ACTGAACGAATGTATACTGTCCACTGCTAG | 138 | GCAGTACTTCTATTATGCTCTCTG | 139 | GGTGCCAACTCCAATTTACCAAACTAGCAGTGGACAGTATACATTCGTTCAGTCAGAGAGCATAATAGAAGTACTGC | 140 |
| DDX5->IQCG | -chr17: 62496667->-chr3: 197640913 | Primer3 | 79 | CCCAAGTTGCTTCAGTTGGT | 141 | CGAAGACAGAGGTTCAGAGTCA | 142 | TTGCAGTTGGTCCTTGAGGT | 143 | CCCAAGTTGCTTCAGTTGGTCGAAGACAGAGGTTCAGAGTCAGAATGAGTATATTGCTAACCTCAAGGACCAACTGCAA | 144 |
| DLG5->ADK | -chr10: 79613112->+chr10: 76153899 | Primer3 | 69 | ACCAGAAGGAGATCGGTGAC | 145 | AATCATCCACTGCTGCTGCTGGG | 146 | CTGCTTTGTGTGGCTGTTG | 147 | ACCAGAAGGAGATCGGTGACCTCCGTGCCCAGCAGCAGCAGTGGATGATTCAACAGCCACACAAAGCAG | 148 |
| DNMBP->TACC2 | -chr10: 101769595->+chr10: 123954555 | Manual | 74 | TGCCTGCCGCGCCGA | 149 | AATCGGAACTCCTGCTTTCCGCCGC | 150 | CGGGGTCTCAAATGCCTCTTC | 151 | TGCCTGCCGCGCCGAGGGACCGCCGGGCGGCGGAAAGCAGGAGTTCCGATTCTGAAGAGGCATTTGAGACCCCG | 152 |
| EIF2C3->ZP2 | +chr1: 36492899->-chr16: 21212879 | Manual | 79 | CCTACAGCTTATTATCGTCATCC | 153 | AGGAATTATCATACACTGGTGTCTTCCCCGGC | 154 | GTTTTCCCCATAAGGTTGTTGG | 155 | CCTACAGCTTATTATCGTCATCCTGCCGGGGAAGACACAGTGTATGATAATTCCTACCAACAACCTTATGGGGAAAAC | 156 |

TABLE C-continued

| Fusion genes | Fusion junction | Primer design method | Amplicon length (bp) | Forward primer | SEQ ID NO:Probe | | SEQ ID NO:Reverse primer | | SEQ ID NO:Amplicon | |
|---|---|---|---|---|---|---|---|---|---|---|
| EIF4A3->TSPEAR | -chr17: 78120592->-chr21: 45953806 | Manual | 82 | ACGTTCG ACACCAT GGGC | 157 | TCGTTC CTCGT AAGCG TAGAT GCCCC | 158 | CACCA CCGTC AGCAG GTA | 159 | ACGTTCGACACC ATGGGCCTGCGG GAGGACCTGCTG CGGGGCATCTAC GCTTACGAGGAA CGAGTACCTGCT GACGGTGGTG | 160 |
| ERBB2->IKZF3 | +chr17: 37868701->-chr17: 37949186 | Manual | 76 | TTTGGGA GCCTGGC ATTT | 161 | CATTG AATCA TCCAT CAAAG CTCTCC GGC | 162 | TCTTTC ACTGT ATTCA TCTTTC AC | 163 | TTTGGGAGCCTG GCATTTCTGCCG GAGAGCTTTGAT GGATGATTCAAT GAAAGTGAAAGA TGAATACAGTGA AAGA | 164 |
| ESR1->AKAP12 | +chr6: 152201906-> +chr6: 151669846 | Manual | 78 | GCTCCGC AAATGCT ACGAAG | 165 | AGTCT CTCTGT CCAAC ACCTTT CATCA TTCCC | 166 | GAGTC TCTTTT GCTCA CATCTT CA | 167 | GCTCCGCAAATG CTACGAAGTGGG AATGATGAAAGG TGTTGGACAGAG AGACTCTGAAGA TGTGAGCAAAAG AGACTC | 168 |
| ESR1->AKAP12 | +chr6: 152265643-> +chr6: 151669846 | Primer3 | 70 | ATGATCA ACTGGGC GAAGAG | 169 | GGTGC CAGTT GGACA GAGAG | 170 | CGGAG TCTCTT TTGCTC ACA | 171 | ATGATCAACTGG GCGAAGAGGGTG CCAGTTGGACAG AGAGACTCTGAA GATGTGAGCAAA AGAGACTCCG | 172 |
| ESR1->C6orf211* | +chr6: 152129499-> +chr6: 151785588 | Manual | 126 | ACCTGGA GAACGA GCCCA | 173 | CGCCG GCATT CTACA GTCCA CC | 174 | CCTGT GACCC ATAGA AATTTT GC | 175 | ACCTGGAGAACG AGCCCAGCGGCT ACACGGTGCGCG AGGCCGGCCCGC CGGCATTCTACA GTCCACCAATCG ATTACTTTGATGT ATTTAAAGAATC AAAAGAGCAAAA TTTCTATGGGTCA CAGG | 176 |
| ESR1->C6orf211** | +chr6: 152129499-> +chr6: 151785588 | Manual | 82 | TACACGG TGCGCGAG | 177 | CCGGC ATTCT ACAGT CCACC AATCGA | 178 | GCTCTT TTGATT CTTTA AATAC ATCAA AGTA | 179 | TACACGGTGCGC GAGGCCGGCCCG CCGGCATTCTAC AGTCCACCAATC GATTACTTTGATG TATTTAAAGAAT CAAAAGAGC | 180 |
| FAM135A->PKIB | +chr6: 71123405-> +chr6: 123038932 | Primer3 | 80 | AGCTCCT CCGTTCG ACAG | 181 | ATAGC AACAT CTCTC GCCCG GCT | 182 | TCATTT TTGAT GAATC TGTCCTC | 183 | AGCTCCTCCGTTC GACAGGCGGGGG AAGAGGCCGAGC CGGGCGAGAGAT GTTGCTATGAGG ACAGATTCATCA AAAATGA | 184 |
| FBXL20->NSF | -chr17: 37453380-> +chr17: 44751780 | Manual | 84 | GGAACAT TGAAGTA CTGAATC TAA | 185 | TTTAC AACGC GTCTG TTGTCT TTGTA CACCC | 186 | TCCAT ATAAC AGGAT GCCTTT AAC | 187 | GGAACATTGAAG TACTGAATCTAA ATGGGTGTACAA AGAACAACAGACG CGTTGTAAACAT GTTAAAGGCATC CTGTTATATGGA | 188 |
| FBXW7->MLL3 | -chr4: 153332455 ->-chr7: 152055760 | Primer3 | 72 | TCCTCCC CATTCTA TACAAA AC | 189 | AGTTTT CCCCC TACTTC GAGGT TTTTGTT | 190 | CTGTC CTCAT CTTCC ACTGC | 191 | TCCTCCCCATTCT ATACCAAAACAA CAAAACCTCGA AGTAGGGGAAA ACTGCAGTGGAA GATGAGGACAG | 192 |

TABLE C-continued

| Fusion genes | Fusion junction | Primer design method | Amplicon length (bp) | Forward primer | SEQ ID NO: | Probe | SEQ ID NO: | Reverse primer | SEQ ID NO: | Amplicon | SEQ ID NO: |
|---|---|---|---|---|---|---|---|---|---|---|---|
| GBAS->PCLO | +chr7: 56032394->-chr7: 82595803 | Manual | 92 | TCCTGCAGCGGGCGGC | 193 | ATTCTTGAATCGGAGCCTGGGCAGGAGGCTG | 194 | CTGATATTGCTCTCTGGGTTTGGC | 195 | TCCTGCAGCGGGCGGCCCCCTGCAGCCTCCTGCCCAGGCTCCGATTCAAGAATGGCTTTGTTTAAATTGCCAAACCCAGAGAGCAATATCAG | 196 |
| GREB1->MBOAT2 | +chr2: 11680234->-chr2: 9098771 | Manual | 80 | TTGGTCTGTGGAGTGCCTGA | 197 | TGGCACACTACAAAGTTGACCTTACAAAAAGCTGG | 198 | CTGCTAGCAAGGCAAAGAG | 199 | TTGGTCTGTGGAGTGCCTGAAGTGACCAGCTTTTTGTAAGGTCAACTTTGTAGTGTGCCAACTCTTTGCCTTGCTAGCAG | 200 |
| HHATL->GRB2 | -chr3: 42744071->-chr17: 73328878 | Manual | 77 | TGGGCAGTGTGCCAGGGT | 201 | CCTTGCGGCCTCCTCAAGGTTTTGAACGAA | 202 | CTGCCTTGTACCAGTTCTGATCAC | 203 | TGGGCAGTGTGCCAGGGTCCCTTGCGGCCTCCTCAAGGTTTTGAACGAAGAATGTGATCAGAACTGGTACAAGGCAG | 204 |
| IGF1R->DCC | +chr15: 99442850->+ch18: 50278424 | Primer3 | 74 | AAAACCTTCGCCTCATCCTA | 205 | TGAAAACCCTTCTAGCTGCTCCTCTCC | 206 | AAGCGCAGTGCTGTGAAA | 207 | AAAACCTTCGCCTCATCCTAGGAGAGGAGCAGCTAGAAGGGTTTTCAAATTAAAGCTTTCACAGCACTGCGCTT | 208 |
| KIF16B->PCSK2 | -chr20: 16553874->+chr20: 17240885 | Manual | 81 | TGAGCGATGGCATCGGTC | 209 | TCCGGCCCATGAATCGCAGCTTCCCTTT | 210 | AGTGGTACAGACCTTCAGC | 211 | TGAGCGATGGCATCGGTCAAGGTGGCCGTGAGGGTCCGGCCCATGAATCGCAGCTTCCCTTTGCTGAAGGTCTGTACCACT | 212 |
| LRP5->KAT6A | +chr11: 68080273->-chr8: 41907225 | Manual | 91 | GCTGCTGGCGCTGTGCGGCT | 213 | CCCGGCCCCCGCCGCGGGATCTTTCTAC | 214 | CCCCAAGAAACTAGTCAGCACTTCAAC | 215 | GCTGCTGGCGCTGTGCGGCTGCCCGGCCCCCGCCGCGGGATTCTTTCTACTAATCCAGATACTTGTTGAAGTGCTGACTAGTTTCTTGGGG | 216 |
| LRP5->SLC22A24 | +chr11: 68133170->-chr11: 62863578 | Primer3 | 63 | CAACGGCAGGACGTGTAA | 217 | TCATGGTGGATCTCACAAGCTGCC | 218 | GGACTGCATCCAACTCCTTC | 219 | CAACGGCAGGACGTGTAAGGCAGCTTGTGAGATCCACCATGAAGAAGGAGTTGGATGCAGTCC | 220 |
| LRP8->TMEM48 | -chr1: 53746259->-chr1: 54275419 | Manual | 84 | AGAAGGACTGCGAGGGTG | 221 | CCGGCTGTGCTACCTGCTATATTCCCAA | 222 | GGTTCATAGCAGTGCTAATCCAAG | 223 | AGAAGGACTGCGAGGGTGGAGCGGATGAGGCCGGCTGTGCTACCTGCTATATTCCCAAGCTTGGATTAGCACTGCTATGAACC | 224 |
| LUC7L3->HNF1B | +chr17: 48797192->-chr17: 36047395 | Manual | 70 | AGAAGCGCAGCAACGTGC | 225 | TGGGACCACGAGAGCTGTCCTCTACAAGCC | 226 | GTGGTGTGTGGCATCAC | 227 | AGAAGCGCAGCAACGTGCGGTGGGACCACGAGAGCTGTCCTCTACAAGCCTGGTGATGCCCACACACCAC | 228 |

TABLE C-continued

| Fusion genes | Fusion junction | Primer design method | Amplicon length (bp) | Forward primer | SEQ ID NO: | Probe | SEQ ID NO: | Reverse primer | SEQ ID NO: | Amplicon | SEQ ID NO: |
|---|---|---|---|---|---|---|---|---|---|---|---|
| NFYA->TDRG1 | +chr6: 41040823-> +chr6: 40347021 | Manual | 82 | CTGGAGC CAATCAG CGCGGG | 229 | TGACC GTTCC GTGCC TCGCT CCCCC GGTTC | 230 | CTCTTC ATTGT AGCTT GATCC TGCGC | 231 | CTGGAGCCAATC AGCGCGGGCAGC GAACCGGGGGAG CGAGGCACGGAA CGGTCACTGCGC AGGATCAAGCTA CAATGAAGAG | 232 |
| PDE4D->ITGA1 | -chr5: 58284320-> +chr5: 52218607 | Manual | 78 | CATGATG TAGATCA TCCTGGTG | 233 | TGTCC AATCA ATTTCT GATCA ATACA AGACA AGC | 234 | CTCAC AGAGT CCTGA AAGTCA | 235 | CATGATGTAGAT CATCCTGGTGTGT CCAATCAATTTCT GATCAATACAAG ACAAGCATGACT TTCAGGACTCTGT GAG | 236 |
| PGAP3->CACNB1 | -chr17: 37840850->-chr17: 37333788 | Primer3 | 75 | CCCCCAT GTACCAC ACCT | 237 | TGATG TCAAA CATTTC CCAGG CGA | 238 | CCTCC AATTG GTTCTC ATCC | 239 | CCCCCATGTACC ACACCTGTGTGG CCTTCGCCTGGG AAATGTTTGACA TCATCCTGGATG AGAACCAATTGG AGG | 240 |
| PIK3C3->RPRD1A | +chr18: 39629569->-chr18: 33613800 | Primer3 | 83 | CAGGCAC CTGGATA ACCTTT | 241 | AAAAA CAGCC AAACC AAACA GGAAGC | 242 | TGACA TCATT GGCTA GGTAG AGA | 243 | CAGGCACCTGGA TAACCTTTTGCTA ACAAAAACAGCC AAACCAAACAGG AAGCTTACTTTTC TCTACCTAGCCA ATGATGTCA | 244 |
| PPP1R12C->IFITM10 | -chr19: 55610152->-chr11: 1769349 | Manual | 74 | GTACTGA GCCTGTT GGAGGA ACTGG | 245 | CCCTG GCGT CCTCCT GTTTCC GG | 246 | AGCGG GGCTG GGCAC TGG | 247 | GTACTGAGCCTG TTGGAGGAACTG GCCCGGAAACAG GAGGACGCCCAG GGCCCCGGCCAG TGCCCAGCCCCG CT | 248 |
| PPP2R1A->NLRP8* | +chr19: 52709316-> +chr19: 56473433 | Primer3 | 84 | AACAGCT GGGAACC TTCACT | 249 | CAGAG TACGT GCACT GCCTG CTGA | 250 | ATGCA GCCCA TTGCTC TC | 251 | AACAGCTGGGAA CCTTCACTACCCT GGTGGGAGGCCC AGAGTACGTGCA CTGCCTGCTGAG CGCCAGAGAGCA ATGGGCTGCAT | 252 |
| PPP2R1A->NLRP8** | +chr19: 52709316-> +chr19: 56473433 | Manual | 89 | AACCTTC ACTACCC TGGTGGG AG | 253 | ATTGC TCTCTG GCGCT CAGCA GGCAG TGCAC GTAC | 254 | GTCTT GCCAC CAACG ATGCA GC | 255 | AACCTTCACTAC CCTGGTGGGAGG CCCAGAGTACGT GCACTGCCTGCT GAGCGCCAGAGA GCAATGGGCTGC ATCGTTGGTGGC AAGAC | 256 |
| PPP2R2D->PANK1 | +chr10: 133761295-> -chr10: 91344222 | Manual | 84 | CTTTGAC AAGTTTG AGTGTTG CTG | 257 | CGGCT CCAAA ATAAC CCTAT CCGAA CCG | 258 | CATTTT GAACA GTTCC AACAG TGC | 259 | CTTTGACAAGTTT GAGTGTTGCTGG AACGGTTCGGAT AGGGTTATTTTG GAGCCGTTGGGG CACTGTTGGAAC TGTTCAAAATG | 260 |
| PREX1->SLC9A8 | -chr20: 47324798-> +chr20: 48431545 | Primer3 | 81 | GCAGATG GAGAAG CTGGAAG | 261 | CTGCA GTCCC ACATC GAAG | 262 | CATGA GTTGT ATTGG GGAACC | 263 | GCAGATGGAGAA GCTGGAAGCCCT GGAGCAGCTGCA GTCCCACATCGA AGGCTGGGAGGA GGTTCCCCAATA CAACTCATG | 264 |

TABLE C-continued

| Fusion genes | Fusion junction | Primer design method | Amplicon length (bp) | Forward primer | SEQ ID NO:Probe | SEQ ID Reverse | SEQ ID NO:primer | SEQ ID NO:Amplicon | SEQ ID NO: |
|---|---|---|---|---|---|---|---|---|---|
| RABEP1->DNAH9 | +chr17: 5250220-> +chr17: 11532734 | Primer3 | 69 | ACTGCGG AAAGAAT TGCAT | 265 AGGGC CGTCTT CAGAA GACCC TTC | 266 CCACC TTTCCC AGTTT GTG | 267 | ACTGCGGAAAGA ATTGCATGAAGG GTCTTCTGAAGA CGGCCCTGGATT TCCACAAACTGG GAAAGGTGG | 268 |
| RAD21->FER1L6 | -chr8: 117878825-> +chr8: 124968232 | Primer3 | 85 | GCAGCGT GGAGAGT ATCATC | 269 AGCCC AAACA TCCCCT TTCTTT GGTGA | 270 ACCCC TTCTCT GCCTT ATTTC | 271 | GCAGCGTGGAGA GTATCATCTCACC AAAGAAAGGGGA TGTTTGGGCTGA AGGTGAAGAAGA AGAGAAATAAGG CAGAGAAGGGGT | 272 |
| RAF1->NKIRAS1 | -chr3: 12705312 ->-chr3: 23942540 | Manual | 77 | GCCGAAC GACAGG ACGTT | 273 TCTTCC ATTCCT GAGGG AGCCA GGCC | 274 CATGT ATACA TCTTCC ATTGTT TCGC | 275 | GCCGAACGACAG GACGTTGGGGCG GCCTGGCTCCCTC AGGAATGGAAGA TTGCGAAACAAT GGAAGATGTATA CATG | 276 |
| RERG->GZMM | -chr12: 15370363-> +chr19: 547280 | Manual | 78 | GGAGGTC AAACTGG CAATATT TGGG | 277 AAAGG AGCTG CCTGA CTTGC CCACG CC | 278 GCCCC CGATG ATCTG GGT | 279 | GGAGGTCAAACT GGCAATATTTGG GAGAGCAGGCGT GGGCAAGTAGGC AGCTCCTTTGGG ACCCAGATCATC GGGGGC | 280 |
| RIMS2->DPYS | +chr8: 104709524->-chr8: 105436617 | Primer3 | 78 | TGTGGAG GTCGAGT GTCATT | 281 CCATTT TACCA CTATG CTTGTT TGAGCG | 282 GCTGG TAACT GCCAC AAATC | 283 | TGTGGAGGTCGA GTGTCATTACGCT CAAACAAGCATA GTGGTAAAATGG ATGAAAACAGAT TTGTGGCAGTTA CCAGC | 284 |
| RREB1->DSP | +chr6: 7108001-> +chr6: 7555951 | Primer3 | 85 | AGACTCG CAGGAGC AACA | 285 CTTATC AGGTC AAACC GGCAC GATG | 286 TGGAT GGTGT TCTGG TTCTG | 287 | AGACTCGCAGGA GCAACACGTGAT GTGTCTACTTATC AGGTCAAACCGG CACGATGTCCAG GCACCAGAACCA GAACACCATCCA | 288 |
| RTN3->ANK1* | +chr11: 63449250->-chr8: 41591587 | Manual | 120 | TCCTTCG GAGCCGA GCCG | 289 CCCAT TCCGC ACAGG AGGAG CTGC | 290 GCCAG ATGCA AGCCA TTC | 291 | TCCTTCGGAGCC GAGCCGTCCGCG CCCGGCGGCGGC GGGAGCCCAGGA GCCTGCCCCGCC CTGGGGACGAAG AGCTGCAGCTCC TCCTGTGCGGAA TGGGTTGAATGG CTTGCATCTGGC | 292 |
| RTN3->ANK1** | +chr11: 63449250->-chr8: 41591587 | Manual | 80 | CCCCGCC CTGGGGA CGAA | 293 CAACC CATTC CGCAC AGGAG AGCT GCAGC | 294 GCCTT CCTTA GAAGC CAGAT GCAAG CC | 295 | CCCCGCCCTGGG GACGAAGAGCTG CAGCTCCTCCTGT GCGGAATGGGTT GAATGGCTTGCA TCTGGCTTCTAAG GAAGGC | 296 |
| SEMA4C->BRE | -chr2: 97527316-> +chr2: 28561317 | Primer3 | 68 | ACACTTC AGGCATC TGCAAC | 297 AATAA GCCCT TTCTTA CTGCC ACGGAG | 298 ACTGA GGGAC AAAGG TTTTGA | 299 | ACACTTCAGGCA TCTGCAACCTCC GTGGCAGTAAGA AAGGGCTTATTT CAAAACCTTTGT CCCTCAGT | 300 |

TABLE C-continued

| Fusion genes | Fusion junction | Primer design method | Amplicon length (bp) | Forward primer | SEQ ID NO:Probe | SEQ ID Reverse | SEQ ID NO:primer | SEQ ID NO:Amplicon | SEQ ID NO: |
|---|---|---|---|---|---|---|---|---|---|
| SEMA4C->RBMS1 | -chr2: 97527316 ->-chr2: 161131275 | Primer3 | 83 | GACACTT CAGGCAT CTGCAA | 301 CCTCC GTGGC AGTAA GAAAG | 302 AGCCT TCACA CCCTTC TTCA | 303 | GACACTTCAGGC ATCTGCAACCTC CGTGGCAGTAAG AAAGATGTACAG AAAGGTGTTCTT ACATGAAGAAGG GTGTGAAGGCT | 304 |
| SFXN1->CAMK4 | +chr5: 174905642-> +chr5: 110782384 | Manual | 85 | AGCGGG ACCTGCG AGCAG | 305 CATGT AGATA CGCTT CCCCC GGGCT GCCGC CC | 306 TGGTTT GAGAT CACGA TGGAC AATCCC | 307 | AGCGGGACCTGC GAGCAGCGCGGG CGGCAGCCCGGG GGAAGCGTATCT ACATGAAAATGG GATTGTCCATCGT GATCTCAAACCA | 308 |
| SNX9->RAB2A | +chr6: 158244478-> +chr8: 61531139 | Manual | 86 | TCCCGGG CCGGGG | 309 CGCCC GCCAT GGCCA CCAAG GCATTT | 310 CTCCTT CTTGA ATTTTT TCATA AATTT CTTTTG CTG | 311 | TCCCGGGCCGGG GGACCCGCCCGC CATGGCCACCAA GGCATTTATTAAT ACAGCAAAAGAA ATTTATGAAAAA ATTCAAGAAGGAG | 312 |
| STAU1->TOP1 | -chr20: 47790732-> +chr20: 39690034 | Manual | 83 | GAACTGA ACAAAG ACAACAT TGTT | 313 CCTGG AACGC CCTCTT TTTAA AAAAG ATTCTC | 314 GATCT TTGTGT TTATCT TTGTGT TTAT | 315 | GAACTGAACAAA GACAACATTGTT CCTGGAACGCCC TCTTTTTAAAAAA GATTCTCATAAA CACAAAGATAAA CACAAAGATC | 316 |
| TANC2->RDM1 | +chr17: 61086987->-chr17: 34247276 | Manual | 81 | ACTGGTG GGAAATC AAGTCGT AA | 317 TCCAC AGCTA TTTTAC CACTTT CACTT GACCTG | 318 GATGT CTTCA CTGGG TCTGTA | 319 | ACTGGTGGGAAA TCAAGTCGTAAA AACAGGTCAAGT GAAAGTGGTAAA ATAGCTGTGGAG TACAGACCCAGT GAAGACATC | 320 |
| TEX10->PICALM | -chr9: 103115054-> -chr11: 85742653 | Primer3 | 85 | CCCTCGC TTGTCTT CTCG | 321 CGGCC GGGTC CTCAG ACTTA ATTCA | 322 TTCAC ATTCA TCTCAT TTGTGC | 323 | CCCTCGCTTGTCT TCTCGGGCTTCTC GCCCCGGCCGCG GCCGGGTCCTCA GACTTAATTCAG TGCACAAATGAG ATGAATGTGAA | 324 |
| TFG->GPR128 | +chr3: 100438902-> +chr3: 100348442 | Manual | 75 | TGCAATT CAGTGCA GTAGGAT | 325 CTGAA ACTGA CATTA TTTGG AAAAT CTACTT CC | 326 TCTGT AGGGG TGCTT GAT | 327 | TGCAATTCAGTG CAGTAGGATACT GAAACTGACATT ATTTGGAAAATC TACTTCCTCATCA AGCACCCCTACA GA | 328 |
| TPP2->BRCA2 | +chr13: 103249553-> +chr13: 32890559 | Primer3 | 83 | CATCGCA GTCCTGG ACAC | 329 TCCGG GCATG CAGAC TCCTCC TTATTT ACCA | 330 CCTAC GATAT TCCTCC AATGC | 331 | CATCGCAGTCCT GGACACGGGGGT CGACCCGGGGGC TCCGGGCATGCA GACTTATTTACCA AGCATTGGAGGA ATATCGTAGG | 332 |
| TRIM37->BCAS3 | -chr17: 57092971-> +chr17: 58786580 | Manual | 84 | TGCGGTT GAGAAA AGGAGG | 333 CCAGA TTTCTT GATGT ATCCC AAGGT GACC | 334 CATTC CCAGT ACTAT GTATTT CATGA AA | 335 | TGCGGTTGAGAA AAGGAGGAAAAT GGTCACCTTGGG ATACATCAAGAA ATCTGGAATTTC ATGAAATACATA GTACTGGGAATG | 336 |

TABLE C-continued

| Fusion genes | Fusion junction | Primer design method | Amplicon length (bp) | Forward primer | SEQ ID NO: | Probe | SEQ ID NO: | Reverse primer | SEQ ID NO: | Amplicon | SEQ ID NO: |
|---|---|---|---|---|---|---|---|---|---|---|---|
| TRPS1->EIF3H | -chr8:116680772->-chr8:117671219 | Manual | 87 | GTGTTCTTGACGATTAATCAACAG | 337 | AGGCTCCGCATCATTTCCATCTGATATTGG | 338 | CCACGTGAAGATGATCAATGTTTA | 339 | GTGTTCTTGACGATTAATCAACAGTCCAATATCAGATGGAAATGATGCGGAGCCTTCGCCATGTAAACATTGATCATCTTCACGTGG | 340 |
| UCK2->TMCO1 | +chr1:165797169->-chr1:165697358 | Primer3 | 63 | CCTTCCTTATAGGCGTCAGC | 341 | GGAACAGCTAGCGGCAAG | 342 | GGCCGAGAATCTTCTGAATG | 343 | CCTTCCTTATAGGCGTCAGCGGGGAACAGCTAGCGGCAAGAACATTCAGAAGATTCTCGGCC | 344 |
| UTP18->ACACA | +chr17:49354665->-chr17:35487144 | Manual | 86 | GTCTATGACATGCTGGCTGGAAA | 345 | CGCCCGAGGACCTCTCACTTGATGC | 346 | GCTGGTTATTGGAGGTGTACACTT | 347 | GTCTATGACATGCTGGCTGGAAAGTTAATTCCTGTGCATCAAGTGAGAGGTCCTCGGGCGGAAGTGTACACCTCCAATAACCAGC | 348 |
| UTP23->RAD21 | +chr8:117779030->-chr8:117879000 | Primer3 | 64 | TACCTCATGGGGAGACG | 349 | CAGCTGTGCACCACAAGGTTTTCTTC | 350 | TCTGGCTGGCTATGAAAACA | 351 | TACCTCATGGGGAGACGCAGCTGTGCACCACAAGGTTTTCTTCTGTTTTCATAGCCAGCCAGA | 352 |
| ZBTB34->SCAI | +chr9:129623018->-chr9:127818286 | Manual | 86 | CGCGGGCGGGCGATGT | 353 | CAAATTCAGTCCTGTCCAGAGCGCCGCGCTC | 354 | CATCTTCAGCACCTCCAGAGGACATG | 355 | CGCGGGCGGGCGATGTGAGCGCGGCGCTCTGGACAGGACTGAATTTGCTCTTAAAGAAATCATGTCCTCTGGAGGTGCTGAAGATG | 356 |

Internal control.
*Old design, which was found to not be optimal
**New design

SEQUENCE LISTING (3278 sequences)

SEQ ID NO: 1 - DNA, 6106 bp, Artificial Sequence
  Description of Artificial Sequence: Synthetic polynucleotide
atggaggcagcgccgcccgggccgccgtggccgctgctgctgctgctgctgctgctgctggcgctgtgcggctgcccggcccccgccgcggatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatga

SEQ ID NO: 2 - DNA, 6126 bp, Artificial Sequence
  Description of Artificial Sequence: Synthetic polynucleotide
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccagttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaa

SEQ ID NO: 3 - DNA, 4286 bp, Artificial Sequence
  Description of Artificial Sequence: Synthetic polynucleotide
atggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 4 - DNA, 1418 bp, Artificial Sequence
  Description of Artificial Sequence: Synthetic polynucleotide
taatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctctctctcttttttaataagggtgggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgactgcttgctcatttga

SEQ ID NO: 5 - DNA, 198 bp, Artificial Sequence
  Description of Artificial Sequence: Synthetic polynucleotide
atggccggggacagcgagcagaccctgcagaaccaccagcagcccaacggcggcgagcccttccttataggcgtcagcgggggaacagctagcggcaagaacattcagaagattctcggccttgccccttcacgagccgccaccaagcaggcaggtggatttcttggcccaccacctccttctgggaagttctcttga

SEQ ID NO: 6 - DNA, 5656 bp, Artificial Sequence
  Description of Artificial Sequence: Synthetic polynucleotide
atggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggaatgggttgaatggcttgcatctggcttctaaggaaggccatgtgaaaatggtggttgaacttctgcacaaagaaatcattctagaaacgacaaccaagaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtga

SEQ ID NO: 7 - DNA, 5754 bp, Artificial Sequence
  Description of Artificial Sequence: Synthetic polynucleotide
atgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccaggcttcccagcagcggcttatggaccagtggcagcagcggcggtggcggcagcaagaggatcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattga

SEQ ID NO: 8 - DNA, 2047 bp, Artificial Sequence
  Description of Artificial Sequence: Synthetic polynucleotide
atgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtga

SEQ ID NO: 9 - DNA, 2503 bp, Artificial Sequence
  Description of Artificial Sequence: Synthetic polynucleotide
atggaggcgcccagcggcagcgagcccggcggcgacggggccggggactgcgcccacccggacccccgggcccctggcgccgcggcgcccagctccggccccggcccgtgcgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggaggaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctagctatctgcatcatattggtgcatttactgatccgatacagattacatttcttgccagagagtgttgctgttgtttctttaggtattctcatgggagcagttataaaaattatagagtttaaaaaactggcgaattggaaggaagaagaaatgtttcgtccaaacatgtttttcctcctcctgcttccccctattatctttgagtctggatattcattacacaagggtaacttctttcaaaatattggttccatcaccctgtttgctgtttttgggacggcaatctccgcttttgtagtaggtggaggaatttattttctgggtcaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaacacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctga

SEQ ID NO: 10 - DNA, 688 bp, Artificial Sequence
  Description of Artificial Sequence: Synthetic polynucleotide
atgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagaccgagaccatcgaaggccacaggagaagaaaaaagccaagggtttggggaaggagatcacgttgctgatgcagacattgaatactctgagtaccccagaggagaagctggctgctctgtgcaagaagtatgctgaactggtaccttgtgggtcaacgactcgtgaactacgaacggaaatctggcaaacaaggctcatctccaccacctccacagtcatcccaagaataa

SEQ ID NO: 11 - DNA, 2325 bp, Artificial Sequence
  Description of Artificial Sequence: Synthetic polynucleotide
atggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgtttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgataattcctaccaacaaccttatggggaaaacgagtaccctctagtgagattcctccgccaaccaatttacatggaagtgagagtcctaaacagggatgaccccaacatcaagctggtcttagatgactgctgggcgacgtccaccatggatccagactctttcccccagtggaacgttgtcgtggatggctgtgcatatgacctggacaactaccagaccaccttccatccagtcggctcctctgtgacccatcctgatcactatcagaggtttgacatgaaggcttttgcctttgtatcagaagcccacgtgctctctagcctggtctacttccactgcagtgccttaatctgtaatcgactctcccctgactccccactgtgttctgtgacctgccctgtgtcctctaggcacaggcgagccacaggggccactgaagcagagaaaatgacagtcagcctcccaggacccattctcctgttgtcagatgactcctcattcagaggtgtcggctcatctgatctaaaagcaagtgggagcagtggggagaagagtaggagtgaaacaggggaggaggttggctcacgaggtgctatggacaccaaagggcacaagactgctggagatgttggttccaaagctgtggctgctgtggctgcctttgcaggtgtggtggcaactctaggcttcatctactacctgtacgagaaaaggactgtgtcaaatcactaa

SEQ ID NO: 12 - DNA, 10422 bp, Artificial Sequence
  Description of Artificial Sequence: Synthetic polynucleotide
atggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcagatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagtagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaa

SEQ ID NO: 13 - DNA, 2579 bp, Artificial Sequence
  Description of Artificial Sequence: Synthetic polynucleotide
atgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaagtctcagtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgacaaaaaatcaccatgtaccaacctatccaaacttatccatggatgaatctatccagaagacgggagttccgatgcttgtcttgctctgaatgtctgcttgtcacctgcttagggttatcgactgtgattctgggactcattgttgttctacaggacccctctgactctgtggttttctctactggattaacaatgatagccataggtgctttttttgttgtcctcactggagtgacagccctgtgtacggttacagtcgacgagaacttgcagaaaaccacgaggctaagactaggagtgatacgaaaaagcggaagtctccaaggaactacagagccttccatgactcactcaataatcgctagcacctcgctgtagttgtacattgaaccctggcatcttcgtctttggaactaagtctcctgagcattgtttttaaatagaaataaaatctggcttttaa

SEQ ID NO: 14 - DNA, 2515 bp, Artificial Sequence
  Description of Artificial Sequence: Synthetic polynucleotide
atggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 15 - DNA, 255 bp, Artificial Sequence
  Description of Artificial Sequence: Synthetic polynucleotide
atgtttcggaatagtctcaagatgctgcttactggtgggaaatcaagtcgtaaaaacaggtcaagtgaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactag

SEQ ID NO: 16 - DNA, 3051 bp, Artificial Sequence
  Description of Artificial Sequence: Synthetic polynucleotide
atgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcagaagggaagcctttggccttgccagtgagaacatcctacaaagcatttagtacaagatggaactggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacggcatgtttcgccaagggatgcatgacttgaaagtctggcctaatgtagaagcagatggatcagaacccacaaaaactcctggcagaacaagtagcactctctcagaagatcagatgagccgtcttgccaagctcaccaaagctcatcgacaaggacacatggtgaaagtagattggctggatagattgacatttagagaaatagaaatgataaatgagagtgaaaaacgaagttctaatttcatgtacctgatggttgaatttcgatgtgtcaagtgtgatgataaggaatatggtattgtttattatgaaaaggacggtgatgaatcatctccaattttaacaagttttgaattagtgaaagttcctgacccccagatgtctatggagaatttagttgagagcaaacaccacaagcttgcccggagtttaagaagtggaccttctgaccacgatctgaaacccaatgctgccacgagagatcagttaaatattattgtgagttatccaccaaccaagcaacttacatatgaagaacaagatcttgtttggaagtttagatattatcttacgaatcaagaaaaagccttgacaaaattcttgaaatgtgttaattgggatctacctcaagaggccaaacaggccttggaacttctgggaaaatggaagccgatggatgtagaggactccttggagctgttatcctctcattacaccaacccaactgtgaggcgttatgctgttgcccggttgcgacaggccgatgatgaggatttgttgatgtacctattacaattggtccaggctctcaaatatgaaaattttgatgatataaagaatggattggaacctaccaagaaggatagtcagagttcagtgtcagaaaatgtgtcaaattctggaataaattctgcagaaatagatagctcccaaattataaccagcccccttccttcagtctcttcacctcctcctgcatcaaaaacaaaagaagttccagatggcgaaaatctggaacaagatctctgtaccttcttgatatcgagagcctgcaaaaactcaacactggctaattatttatactggtatgtgatagtggaatgtgaagatcaagatactcagcagagagatccaaagacccatgagatgtacttgaacgtaatgagaagattcagccaagcattgttgaagggtgataagtctgtcagagttatgcgttctttgctggctgcacaacagacatttgtagatcggttggtgcatctaatgaaggcagtacaacgcgaaagtggaaatcgtaagaaaaagaatgagagactacaggcattgcttggagataatgaaaagatgaatttgtcagatgtggaacttatcccgttgcctttagaaccccaagtgaaaattagaggaataattccggaaacagctacactgtttaaaagtgcccttatgcctgcacagttgttttttaagacggaagatggaggcaaatatccagttatatttaagcatggagatgatttacgtcaagatcaacttattcttcaaatcatttcactcatggacaagctgttacggaaagaaaatctggacttgaaattgacaccttataaggtgttagccaccagtacaaaacatggcttcatgcagtttatccagtcagttcctgtggctgaagttcttgatacagagggaagcattcagaacttttttagaaaatatgcaccaagtgagaatgggccaaatgggattagtgctgaggtcatggacacttacgttaaaagctgtgctggatattgcgtgatcacctatatacttggagttggagacaggcacctggataaccttttgctaacaaaaacagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattga

SEQ ID NO: 17 - DNA, 1375 bp, Artificial Sequence
  Description of Artificial Sequence: Synthetic polynucleotide
atggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgagcgccagagagcaatgggctgcatcgttggtggcaagacttatgctctgtgtttgcaacgaatgataagctggaagtcctgactatgaccaacagtgttttggggcctccttttttgaaggctctcgcggccgcactgaggcaccctcagtgcaaactgcaaaagctactcctaaggcgtgtgaatagcaccatgttgaaccaggacttaatcggtgttttgacggggaaccagcatctgagatacttggaaatacaacatgtggaagtggagtccaaagctgtgaagcttctatgcagggtgctgagatccccccggtgccgtctgcagtgtctcaggttggaagactgcttggccacccctagaatttggactgatcttggcaataatcttcaaggtaacgggcatctaaagactctcatactaagaaaaaactccctggagaactgtggggcgtattacctgtctgtggcccagctggagaggctgtcgatagagaactgcaaccttacacagcttacttgtgaaagccttgcctcctgtctcaggcagagtaagatgctgacccacctgagcttggcagaaaacgccttgaaagatgaaggggccaagcatatttggaatgccctgccacacctgagatgtcctctgcagaggctggtactgagaaagtgtgacttgacctttaattgctgtcaggatatgatctctgcgctctgtaaaaataaaaccctgaaaagtcttgacctaagttttaatagcctgaaggatgatggggtgatcctgctgtgtgaggccctgaagaaccctgactgtacattacagatcctggagctggaaaactgcctgttcacctccatctgctgccaggccatggcttccatgctccgcaaaaaccaacatctgagacatctggacttgagcaagaatgcgattggagtctatggtattctgaccttgtgcgaggccttctcaagccaaaagaagagagaagaggtcattttctgtattcctgcctggactcgaataactagcttctccccaactcctcacccacccgacttcacgggaaaaagtgactgcctatcccagattaatccttag

SEQ ID NO: 18 - DNA, 1589 bp, Artificial Sequence
  Description of Artificial Sequence: Synthetic polynucleotide
atggacaccagccgtgtgcagcctatcaagctggccagggtcaccaaggtcctgggcaggaccggttctcagggacagtgcacgcagggttcttctgctcactgggtcagaagcatccgatttcctgtcatcggttgcggttcagccatgttaatactgaaagtataagaatatcataatcccagagtgatataaagacctttccaaggaagatgagatacccggaggctgtgaaggagaagtctgaaggatttgaacgcgttcaaatgaaaacctttggttcagcaaaacaccagaaacaaattcaaaagataaaatacactccggagaagcccattctctcaacgcatctgacagttcacaaagagcaactgcagtccaacttaaaaaataaagaaaatggtaggaaaatgggcaacatgcactgaggcaatatataagaagaaggaatgcgcaattaatcaacaaaagcctgctctttcctaacgagtgaagatacaagcttagtaaatattaaaatttattgaagataaaaatggacacttccggccatatataaaagcattgttggtaagagagtggggtaattgacatgctcctgggaaataatacgcattcagacaacctctaatgagtgaatccactgggggtatccactaggaatagaaaacgaccaccaatgcccaagtttgtggtccagaatttgagcagcgatctaacaaagtagagtctccccctgtgtcatgggccccacttcttaagcaaagaagaatgcctcattttggtaactcacccaaataaacagaaattttttttgataatcttatcgcatttatttggttaagtctgaggcagaatatttttctcctttgtatctttgttttgttttgttttaatccttgaagtttattaccaaactacatcttggtgtttcttcaggatgtgaacaggcctttctattctcaattaagtgtttctttcctttaattcaggaatcttctaatcatgtattttaatttctttttctgtcatccctccccacgccataagctaccagtcactatacatgttggagctctctttattgtgccatagatctctgatgtcatgtctttagtcattattttgtgtcagaaatttttgttcttccggggacatctggcaatatctagagacatgctactggcacctatagaaatgctagtgacttattatgggtagaggctaaagatgctgctaaatatcctacaatgcccaggacagccactgccacaacaaagaattatgcagtccacaatgtccatagtgctaaggagaagaaaccctgtcctagggtcaaggttggatgctgacaagactaatttcaagtgatttcaaacgattgtggggaaaatacccagaagttgacaggagcaatatgtagatatttccttctgtaaattatatttccctaatgctaatgctggagcatttggaaacacgtgtataaatatttgaagcacaaaaccagagagatgctcttatgtatttagcttctagttttaaataatagatactacaataaaccttgattaaaccttgattatctg

SEQ ID NO: 19 - DNA, 612 bp, Artificial Sequence
  Description of Artificial Sequence: Synthetic polynucleotide
gaacggtcactgcgcaggatcaagctacaatgaagaggagggaggcagtctgcgcgcaccgccattttctaggaactgggaagcccccccaccccttaggaagatccatccctgtggaaccttgcccaggcttaccagcctttgctgaggttgatctattgtccctccttgtccccatcaaaatatccagcactccaccttcagggagtagacttgaccctcaaatagcaagttcagccttcccaggtctaggttccctgggaggtcaagattcgtctggttccttagtacagagggctagctgtgagttggaatccccctatgagctttagaatcagtcaagaggaattgggccccttcccttcatccctcttcttttccctttttgtcccagagctcagctctgactcaaaagtttttccatttaccatcaacatggaaacttggctcctcacgtaggtatattatcccccttttgtacatggtcttgttgatccaaactccctttctgtgaaagaggcctgtggggctcaagaagcctggtcagccagccaggctagtcccacatacctcagaaccagtttaataaaggctctatgtcattcttttttg

SEQ ID NO: 20 - DNA, 855 bp, Artificial Sequence
  Description of Artificial Sequence: Synthetic polynucleotide
atgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaaaaaactgcatcagcagtttgaaatgtataaagagcaggtaaagaagatgggagaagaatcacagcaacagcaagaacagaagggtgatgcgccaacctgtggtatctgccacaaaacaaagtttgctgatggatgtggccataactgttcatattgccaaacaaagttctgtgctcgttgtggaggtcgagtgtcattacgctcaaacaagcatagtggtaaaatggatgaaaacagatttgtggcagttaccagcacaaatgcagccaaaatttttaatctctatccaagaaaaggaagaatagctgtaggatcagatgctgacattgttatttgggacccaaaaggcacaaggactatctcagcaaaaactcatcatcaggctgttaacttcaacattttcgagggcatggtttgccacggggtgccccttgtgactatttcaagaggcaaagtggtatatgaagccggagtgttcagtgtcacggcaggagatgggaagtttattcctcgaaaaccatttgctgaatatatttacaaacgaataaagcagcgagaccggacttgcacacctacccctgtggagcgtgcaccctataagggagaagtcgccacactgaaatccagagtgacaaaagaagatgccacagcagggaccaggaaacaggcccacccctga

SEQ ID NO: 21 - DNA, 1029 bp, Artificial Sequence
  Description of Artificial Sequence: Synthetic polynucleotide
atgcgaaactggctggtgctgctgtgcccgtgtgtgctcggggccgcgctgcacctctggctgcggctgcgctccccgccgcccgcctgcgcctccggggccggccctgcagatcagttggccttatttcctcagtggaaatctactcactatgatgtggtagttggcgtgttgtcagctcgcaataaccatgaacttcgaaacgtgataagaagcacctggatgagacatttgctacagcatcccacattaagtcaacgtgtgcttgtgaagttcataataggtgctcatggctgtgaagtgcctgtggaagacagggaagatccttattcctgtaaactactcaacatcacaaatccagttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggaggccctcttcattgctcgcttcagtcctccaagctgtggtgtgcaggtgaacaagctgtggtacaagcccgtggaacaattcatcttaccagagagctttgaaggtacaatcgtgtgggagagccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcagggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgaagatgatgtggaatga

SEQ ID NO: 22 - DNA, 12075 bp, Artificial Sequence
  Description of Artificial Sequence: Synthetic polynucleotide
atgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctgctctcagaaaaagagaagaaacaaatatctgagcaattgaatgccctaaacaaggcttaccatgacctttgtgatggttctgcaaatcagcttcagcagcttcagagccagttggctcaccagacagaacaaaagaccctgcagaaacaacaaaatacctgtcaccagcaactggaggatctttgcagttgggtaggacaggcagaaagagcactggcaggccaccaaggcagaaccacccagcaggatctctctgctttgcagaagaaccaaagtgacttgaaggatttacaggatgacattcagaatcgtgccacctcatttgccactgttgtcaaggacattgaggggttcatggaagagaatcagaccaagctgagcccacgtgagttgacagctcttcgggaaaagcttcatcaggctaaggagcaatatgaggcgctccaggaagagacacgtgtggcccagaaggaactggaggaagcagtgacctccgccttacagcaggagactgaaaagagtaaagcagcaaaggaactggcagagaacaagaagaagatcgatgctctcctggattgggtaacttcagtaggatcatctggtggacagctgctgaccaaccttccaggaatggagcagctctcgggagctagcttggagaaaggagccttggacaccactgatggttacatgggggtgaatcaagccccagagaaactggacaagcaatgtgagatgatgaaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaagtgtacacgattaggatctcacctgaatatgctgttaggccagtatcatcaattccaaaacagtgctgacagcctgcaggcctggatgcaggcttgtgaggccaacgtggagaagctcctctcagatactgttgcctctgaccctggagttctccaggagcagcttgcaacaacaaagcagttgcaggaggaattggctgagcaccaagtacctgtggaaaaactccaaaaagtagctcgtgacataatggaaattgaaggggagccagccccagaccacaggcatgttcaagaaactacagattccatactcagccacttccaaagcctctcctatagcctggctgagcgatcttctctgctgcagaaagcaattgcccaatctcagagtgtccaggaaagcctggagagcctgttgcagtctattggggaagttgaacaaaacctggaagggaagcaggtgtcatcactctcatcaggagtcatccaggaagccttagccacaaatatgaaattgaagcaggacattgctcggcaaaagagcagcttggaggccacccgtgagatggtgacccgattcatggagacagcagacagtactacagcagcagtgctgcagggcaaactggcagaggtgagccagcggttcgaacagctctgtctacagcagcaagaaaaggagagctccctaaagaagcttctaccccaggcagagatgtttgaacacctctctggtaagctgcagcagttcatggaaaacaaaagtcggatgctggcctctggaaatcagccagatcaagatattacacatttcttccaacagatccaggagctcaatttggaaatggaagaccaacaggagaacctagatactcttgagcacctggtcactgaactgagctcttgtggctttgcgctggacttgtgccagcatcaggacagggtacagaatctaagaaaagacttcacagagctacagaagacagttaaagagagagagaaagatgcatcatcttgccaggaacagttggatgaattccggaagctggtcaggaccttccagaaatggttgaaagaaactgaagggagtattccacctacggaaacttctatgagtgctaaagagttagaaaagcagattgaacacctgaagagtctactagatgactgggcaagtaagggaactctggtggaagaaatcaattgcaaaggtacttctttagaaaatctcatcatggaaatcacagcacctgattcccaaggcaagacaggttccatactgccctctgtaggaagctctgtaggcagtgtaaacggataccacacctgcaaagatctgacggagatccagtgtgacatgtcagatgtaaacttgaagtatgagaaactagggggagtacttcatgaacgccaggaaagccttcaggctatcctcaacagaatggaggaggttcacaaggaggcaaactctgtgctgcagtggctggaatcaaaagaggaagtcctgaaatccatggatgccatgtcatctccaaccaagacagaaacagtgaaagcccaagctgaatctaacaaggccttcctggctgagttggaacagaattctccaaaaattcaaaaagtaaaggaagccctggctggattactggtgacatatcccaactcacaggaagcagaaaattggaagaaaattcaggaagaactcaattcccgatgggaaagggccactgaggttactgtggctcggcaaaggcagctagaggaatctgcaagtcatctggcctgcttccaggctgcagaatcccagctccggccgtggctgatggagaaagaactgatgatgggagtgctggggcccctgtctattgaccccaacatgttgaatgcacaaaagcaacaggtccagtttatgctaaaggaatttgaagcacgcaggcaacagcatgagcaactgaatgaggcagctcagggcatcctaacaggccctggagatgtctctctgtccaccagccaagtacagaaagaactccagagcatcaatcagaaatgggttgagctgactgacaaactcaactcccgttccagccaaattgaccaagctattgttaagagcacccagtaccaggaactgctccaggacttatcagagaaggtgagggcagttggacaacggctgagtgtccagtcagctatcagcacccaaccagaggctgtaaagcagcaattggaagagaccagtgaaattcgatctgacttggagcagttagaccacgaggttaaggaggctcagacactgtgcgatgaactctcagtgctcattggtgagcagtacctcaaggatgaactgaagaagcgtttggagacagttgccctgcctctccaaggtttagaagaccttgcagccgatcgcattaacagactccaggcagctcttgccagcacccagcagttccagcaaatgtttgatgagttgaggacctggttggatgataaacaaagccagcaagcaaaaaactgcccaatttctgcaaaattggagcggctacagtctcagctacaggagaatgaagagtttcagaaaagtcttaatcaacacagtggctcctatgaggtgattgtggctgaaggggaatctctacttctttctgtacctcctggagaagagaaaaggactctacaaaaccagttggttgagctcaaaaaccattgggaagagcttagtaaaaaaactgcagacagacaatccaggctcaaggattgtatgcagaaagctcagaaatatcagtggcatgtggaagaccttgtgccatggatagaagattgtaaagctaagatgtctgagttgcgagtcactctggatccagtgcagctagagtccagtctcctaagatcaaaggctatgctgaatgaggtggagaagcgccgctccctgctggaaatattgaatagtgctgctgacattctgatcaattcttcagaagcagatgaggatggaatccgggatgagaaggctgggatcaaccagaacatggatgctgttacagaagagctgcaggccaaaacagggtcactcgaagaaatgactcagaggctcagggagttccaggaaagctttaagaatattgaaaagaaggttgaaggagccaaacaccaacttgagatctttgatgctctgggttctcaagcctgtagcaacaagaacctggagaagctaagagctcaacaggaagtgctgcaggccctagagcctcaggtagactatctgaggaactttactcagggtctggtagaagatgccccagatggatctgatgcttctcaacttctccaccaagctgaggtcgcccagcaagagttcctcgaagttaagcaaagagtgaacagtggttgtgtgatgatggaaaacaagctggaggggattggccagtttcactgccgggtccgagagatgttctctcaattggcagacctggatgatgagctagatggcatgggtgctattggcagagacactgatagcctccagtcccaaatcgaggatgtccggctattccttaacaaaattcacgtcctcaaattagacatagaggcctctgaagcagagtgtcgacatatgctagaagaagaggggactctggatttgttaggtctcaaaagggagctagaagccctgaacaaacagtgtggcaaactgacagagagggggaaagctcgtcaggaacagctggaactgacactaggccgtgtagaggacttctacaggaaattgaaaggactcaatgacgcgaccacagcagcagaggaggcagaggccctccagtgggtagtggggaccgaagtggaaatcatcaaccaacaattagcagattttaaaatgtttcagaaagaacaagtggatcctcttcagatgaaattgcagcaggtgaatggacttggccagggattaattcagagtgcaggaaaagactgtgatgtacagggtttagaacatgacatggaagagatcaatgctcgatggaatacattgaataaaaaggtcgcacaaagaattgcacagctacaggaagctttgttgcattgtgggaagtttcaagatgccttggagccattgctcagctggttggcagataccgaggagctcatagccaatcagaaacctccatctgctgagtataaagtggtgaaagcacagatccaagaacagaagttgctccagcggctcctagatgatcgaaaggccacagtagacatgcttcaagcagaaggaggcagaatagcccagtcagcagagctggctgatagagagaaaatcactggacagctggagagtcttgaaagtagatggactgaactactcagtaaggcagcagccaggcaaaaacagctggaagacatcctggttctggccaaacagttccatgagacagctgagcctatttctgacttcttatctgtcacagagaaaaagcttgctaactcagaacctgttggcactcagactgccaaaatacagcagcagatcattcggcacaaggctctggaagaagacatagaaaaccatgcaacagatgtgcaccaggcagtcaaaattgggcagtccctctcctccctgacatctcctgcagaacagggtgtgctgtcagaaaagatagactcattgcaggcccgatacagtgaaattcaagaccgctgttgtcggaaggcagccctacttgaccaagctctgtctaatgctaggctgtttggggaggatgaggtggaggtgctcaactggctggctgaggttgaggacaagctcagttcagtgttcgtaaaggatttcaaacaggatgtcctgcacaggcagcatgctgaccacctggctttaaatgaagaaattgttaatagaaagaagaatgtagatcaagctattaaaaatggtcaggctcttctaaaacaaaccacaggtgaggaggtgttacttatccaggaaaaactagatggtataaagactcgttacgcagacatcacagttactagctccaaggccctcagaactttagagcaagcccggcagctggccaccaagttccagtctacttatgaggaactgaccgggtggctgagggaggtggaggaggagctggcaaccagtggaggacagtctcccacaggggaacagataccccagtttcagcagagacagaaggaattaaagaaggaggtcatggagcacaggctggtgttggacacagtgaatgaggtgagccgtgctctcttagagctggtgccctggagagccagagaagggctggataaacttgtgtccgatgctaacgagcagtacaaactagtcagtgacactattggacaaagggtggatgaaattgatgctgctattcagagatcacaacagtatgagcaagctgccgatgcagaactagcttgggttgctgaaacaaaacggaaactgatggctctgggtccaattcgcctggaacaggaccagaccacagctcagcttcaggtacagaaggctttctccattgacattattcgacacaaagattcaatggatgaactcttcagtcaccgtagtgaaatctttggcacatgtggggaggagcaaaaaactgtattacaggaaaagacagagtctctaatacagcaatatgaagccattagcctactcaattcagagcgttatgcccgcctagagcgggcccaggtcttagtaaaccagttttgggaaacttatgaagagctcagcccctggattgaggaaactcgggcactaatagcacagttaccctctccagccattgatcatgagcagctcaggcagcaacaagaggaaatgaggcaattaagggaatctattgctgaacacaaacctcatattgacaaactactaaagataggcccacaactaaaggaattaaaccctgaggaaggggaaatggtggaagaaaaataccagaaagcagaaaacatgtatgcccaaataaaggaggaggtgcgccagcgagccctggctctggatgaagccgtgtcccagtccacacagattacagagtttcatgataaaattgagcctatgttggagacactggagaatctttcctctcgcctgcgtatgccaccactgatccctgctgaagtagacaagatcagagagtgcatcagtgacaataagagtgccaccgtggagctagaaaaactgcagccatcctttgaggccttgaagcgccgtggagaggagcttattggacgatctcagggagcagacaaggatctggctgcaaaagaaatccaggataaattggatcaaatggtattcttctgggaggacatcaaagctcgggctgaagaacgagaaatcaaatttcttgatgtccttgaattagcagagaagttctggtatgacatggcagctctcctgaccaccatcaaagacacccaggatattgtccatgacttggaaagcccaggcattgatccttccatcatcaaacaacaggttgaagctgctgagactattaaggaagagacagatggtctgcatgaagagctggagtttattcggatccttggagcagatttgatttttgcctgtggagaaactgagaagcctgaagtgaggaagagcattgatgagatgaataatgcttgggagaacttaaacaaaacatggaaagagaggctagaaaaacttgaggatgctatgcaagctgctgtgcagtatcaggacactcttcaggctatgtttgactggctagataacactgtgattaaactctgcaccatgccccctgttggcactgacctcaatactgttaaagatcagttaaatgaaatgaaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtcctaaaaaatgatgttttggctcatcaagccacagtggaaacagtcaacaaagctggcaatgagcttcttgaatccagtgctggagatgatgccagcagcttaaggagccgtttggaagccatgaaccaatgctgggagtcagtgttacagaaaacagaggagagggagcagcagcttcagtcaactctgcagcaggcccagggcttccacagtgaaattgaagatttcctcttggaacttactagaatggagagccagctttctgcatctaagcccacaggaggacttcctgaaactgctagggaacagcttgatacacatatggaactctattcccagctgaaagccaaggaagagacttataatcaactacttgacaagggcagactcatgcttctaagccgtgacgactctgggtctggctccaagacagaacagagtgtagcacttttggagcagaagtggcatgtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctgctcttttcgggtcagttcatggatgctttgcaggcattggttgactggttatacaaggtggagccacagctggctgaggaccagcccgtgcacggggaccttgacctcgtcatgaacctcatggatgcacacaaggttttccagaaggaactgggaaagcgaacaggaaccgttcaggtcctgaagcggtcaggccgagagctgattgagaatagtcgagatgacaccacttgggtaaaaggacagctccaggaactgagcactcgctgggacactgtctgtaaactctctgtttccaaacaaagccggcttgagcaggccttaaaacaagcggaagtgtttcgagacacagtccacatgctgttggagtggctttctgaagcagagcaaacgcttcgctttcggggagcacttcctgatgacacagaggccctgcagtctctcattgacacccataaggaattcatgaagaaagtagaagaaaagcgagtggacgttaactcagcagtagccatgggagaagtcatcctggctgtctgccaccccgattgcatcacaaccatcaaacactggatcaccatcatccgagctcgcttcgaggaggtcctgacatgggctaagcagcaccagcagcgtcttgaaacggccttgtcagaactggtggctaatgctgagctcctggaagaacttctggcatggatccagtgggctgagaccaccctcattcagcgggatcaggagccaatcccgcagaacattgaccgagttaaagcccttatcgctgagcatcagacatttatggaggagatgactcgcaaacagcctgacgtggaccgggtcaccaagacatacaaaaggaaaaacatagagcctactcacgcgcctttcatagagaaatcccgcagcggaggcaggaaatccctaagtcagccaacccctcctcccatgccaatcctttcacagtctgaagcaaaaaacccacggatcaaccagctttctgcccgctggcagcaggtgtggctgttagcactggagcggcaaaggaaactgaatgatgccttggatcggctggaggagttgaaagaatttgccaactttgactttgatgtctggaggaaaaagtatatgcgttggatgaatcacaaaaagtctcgagtgatggatttcttccggcgcattgataaggaccaggatgggaagataacacgtcaggagtttatcgatggcattttagcatccaagttccccaccaccaagttagagatgactgctgtggctgacattttcgaccgagatggggatggttacattgattattatgaatttgtggctgctcttcatcccaacaaggatgcgtatcgaccaacaaccgatgcagataaaatcgaagatgaggttacaagacaagtggctcagtgcaaatgtgcaaaaaggtttcaggtggagcagatcggagagaataaataccggtttggggattctcagcagttgcggctggtccgtattctgcgcagcaccgtgatggttcgcgttggtggaggatggatggccttggatgaatttttagtgaaaaatgatccctgccgagcacgaggtagaactaacattgaacttagagagaaattcatcctaccagagggagcatcccagggaatgacccccttccgctcacggggtcgaaggtccaaaccatcttcccgggcagcttcccctactcgttccagctccagtgctagtcagagtaaccacagctgtacatccatgccatcttctccagccaccccagccagtggaaccaaggttatcccatcatcaggtagcaagttgaaacgaccaacaccaacttttcattctagtcggacatcccttgctggtgataccagcaatagttcttccccggcctccacaggtgccaaaactaatcgggcagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataa

SEQ ID NO: 23 - DNA, 1083 bp, Artificial Sequence
  Description of Artificial Sequence: Synthetic polynucleotide
atggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctga

SEQ ID NO: 24 - DNA, 3881 bp, Artificial Sequence
  Description of Artificial Sequence: Synthetic polynucleotide
cacttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtggagttttgctcttgtcgcccaggctggagtgcagtggcgtgatctcggctcactgcaacctccacctcccaggttcaagcgattttcccacttcagcctcccgataagctgagattacagagtttattaaccacttaacctctcagaactgaacaaagacaacattgttcctggaacgccctctttttaaaaaagattctcataaacacaaagataaacacaaagatcgagaacaccggcacaaagaacacaagaaggagaaggaccgggaaaagtccaagcatagcaacagtgaacataaagattctgaaaagaaacacaaagagaaggagaagaccaaacacaaagatggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaaaattaaaacagaagataccaagaaggagaagaaaagaaaactagaagaagaagaggatggtaaattgaaaaaacccaagaataaagataaagataaaaaagttcctgagccagataacaagaaaaagaagccgaagaaagaagaggaacagaagtggaaatggtgggaagaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttaaagactggagaaaggaaatgactaatgaagagaagaatattatcaccaacctaagcaaatgtgattttacccagatgagccagtatttcaaagcccagacggaagctcggaaacagatgagcaaggaagagaaactgaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaaagatgccaaggttccttctcctcctccaggacataagtggaaagaagtccggcatgataacaaggttacttggctggtttcctggacagagaacatccaaggttccattaaatacatcatgcttaaccctagttcacgaatcaagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtttttaagaacctacaactatttatggagaacaagcagcccgaggatgatctttttgatagactcaatactggtattctgaataagcatcttcaggatctcatggagggcttgacagccaaggtattccgtacatacaatgcctccatcacgctacagcagcagctaaaagaactgacagccccggatgagaacatcccagcgaagatcctttcttataaccgtgccaatcgagctgttgcaattctttgtaaccatcagagggcaccaccaaaaacttttgagaagtctatgatgaacttgcaaactaagattgatgccaagaaggaacagctagcagatgcccggagagacctgaaaagtgctaaggctgatgccaaggtcatgaaggatgcaaagacgaagaaggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaatggaaa

SEQ ID NO: 25 - DNA, 15076 bp, Artificial Sequence
  Description of Artificial Sequence: Synthetic polynucleotide
atgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaacctcgaagtagggggaaaactgcagtggaagatgaggacagcatggatgggctggagacaacagaaacagaaacgattgtggaaacagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaaagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggcacttgttgggctcatcaccgttgtgtggagtggtcactaggagtatgccagatggaagaaccattgttagtgaacgtggacaaagctgttgtctcagggagcacagaacgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatcgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaaccagttatgaaatcagtaccaaccaatggctggaaatgcaaaaattgcagaatatgtatagagtgtggcacacggtctagttctcagtggcaccacaattgcctgatatgtgacaattgttaccaacagcaggataacttatgtcccttctgtgggaagtgttatcatccagaattgcagaaagacatgcttcattgtaatatgtgcaaaaggtgggttcacctagagtgtgacaaaccaacagatcatgaactggatactcagctcaaagaagagtatatctgcatgtattgtaaacacctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactga

SEQ ID NO: 26 - DNA, 4043 bp, Artificial Sequence
  Description of Artificial Sequence: Synthetic polynucleotide
atggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggtgcccaggccttctggttggtagcggaagaccaggacaatgaccctctgacctatgggatgagcggccccaatgcctacttcttcgctgtcactccgaaaactggggaagtgaagctggccagcgctctggactacgagacactctacacattcaaagtcaccatctccgtgagcgacccctacatccaggtgcagagggagatgctggtgattgtggaagatagaaacgacaacgcacccgttttccagaacaccgctttctccaccagcatcaacgagaccctgcccgtgggcagtgtggtgttctccgtgctggccgtggataaagacatggggtctgcaggcatggtcgtgtactccatagagaaggtcatccctagcactggggacagcgagcatctcttccggatcctggccaatggctccatagtcctcaatggcagcctcagctacaacaacaagagcgctttctaccagctggagctgaaggcctgtgacttgggcggcatgtaccacaacaccttcaccatccagtgctccctgcctgtcttcctgtccatctccgtggtggaccagcctgaccttgacccccagtttgtcagggagttttactcggcctctgtggctgaggatgcagccaagggaacctcggtgctgacggtggaggctgtggatggcgacaaaggcatcaatgaccctgtgatctacagcatctcctactccacgcggcccggctggtttgacatcggggcagatggggtgatcagggtcaacggctccctggaccgtgagcagctgctggaggcggatgaggaggtgcagctgcaggtcacggccaccgagacacacctcaacatctacgggcaggaggccaaggtgagcatctgggtgacagtgagagtgatggacgtcaatgaccacaaacctgagttttacaactgcagcctcccagcctgcaccttcacccccgaagaggcccaagtgaacttcactggctacgtggacgagcatgcctccccccgcatccccatcgatgacctcaccatggtggtctacgacccggacaagggcagcaatggcaccttcctgttgtcgctggggggccccgatgcagaagccttcagcgtctccccggagcgggcagtgggctcagcctccgttcaggtgctggtgagagtatccgcgctggtggactacgagaggcagacggcgatggcggtgcaggttgtggccacagactccgtcagccagaacttctccgtcgccatggtgaccatccaccttagagacattaatgaccacaggcccacgtttccccagagcttgtacgtcctcacggtgccagagcacagcgccaccggctctgtggtcaccgacagcatccacgccacggacccagacacgggcgcgtggggccaaattacctacagcctgctcccaggaaatggggcagacctcttccaagtggatcccgtctcagggacggtgacggtgaggaacggtgagctgctggaccgggagagccaggccgtgtactacctgacgctgcaggccacagacggcgggaacctgtcctcctccaccacactgcagatccacctgctggacatcaacgacaatgcacccgtggttagcggctcctacaacatcttcgtccaggaggaggagggcaatgtctccgtgaccatccaggcccacgacaatgatgagccgggcaccaacaacagccgtctgctcttcaacctgctgcctggcccctacagccacaacttctccttggaccctgacacagggctcctcagaaacctggggcccctggacagagaggccatcgaccccgccctggagggccgcattgtgctgacagtgcttgtgtctgactgcggcgagcctgtcctcggcaccaaagtcaatgtcaccatcactgtggaggacatcaatgataacctgcccatcttcaatcagtccagctacaactttacggtgaaggaggaggatccaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcccccggacgtgagcctggattacgagacacagcccgtcttcaacttgacagtgagtgctgagaacccagacccccaggggggtgagaccatagtagacgtctgcgtgaatgtgaaagacgtgaacgacaatccccccaccctggatgtagcctcactccggggcatccgtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtga

SEQ ID NO: 27 - DNA, 2392 bp, Artificial Sequence
  Description of Artificial Sequence: Synthetic polynucleotide
atgatgcacgtgaataattttccctttagaaggcattcctggatatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaagacaagcatgactttcaggactctgtgagaataacgttggactttaatcttaccgatccagaaaatgggcctgttcttgatgattctctaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatga

SEQ ID NO: 28 - DNA, 2114 bp, Artificial Sequence
  Description of Artificial Sequence: Synthetic polynucleotide
atggcggaacgaggcctggagccgtcgccggccgcggtggcggcgctgccgcctgaagtgcgggcgcagctggcggagctggagctggagctctcggagggggacatcacccagaagggctatgaaaagaaaaggtccaaactcctatctccttacagcccgcagacacaagaaactgattcagcagtacagaaagaacttagaaaccagacacctgctccatctgcagctcaaacttctgctccctctaagtaccaccgaactcgatctgggggagccagggatgaacgatatcgatcagagtcttgctctgtcgcccaggctggagtgcagtggtgcgaccttggctcactggtttggggcatgttcctgggtgtgtctgtgaggagcaagaaagccagttcaagtcccaaaacctcaaaagtagggaagccgacagggcagccttaagtctgtggctgaaggcctgagagaccctggcaaatcactgatataagtccaaaagctgaagaacttggaatctgatgttggaatctgatcttggcccatccttgaagaatctgggggtaataaataccctgaacattgatgaacccaaagggaagccagaaggtcagatgtcagctgtcgggaagaaaggctggataggaaataggaaaaagcagggcaaacaaggagcttcaaggactgaaacccttaagaaccacttgactctgtctctcaccacctccagccttgatgacacggtgacatatagaagaactgatgccctttgctttgagctgcacaaaaacctggcgctggacttggagaagctgaaagacaggacccggcaggagcctgaggagctgcaggctgctagcctgtagaccaccgtgctgtgttagccactgcagctgggaccattctgacactcagagcctggaaatggctgctccctcctgcctgctatccaagtatcctgtggatacttggcttttctcttgtgggcaacactaacctgaaactctttggggaagggaattgaggaaatgtagttccaagattagccaatttaactcagcataaacccatcacagggtttgactacagagttataacgttattctgtaggcaatgaaaacagaagtttttgaaaaaggcatcaatttgatgaaattgatattttggggaagattaatcttctgctgagtaaaatataacaggttggaggaagatgaaaatggagagagtagagtgtaattaaaagtttgttggaggccgggcacgggattacggctcactcctgtaatcccagcactttgggaggctgaggtgggcggatcacctgaggtcaggagcttgagatcatcccggccaacatagtgaaaccctgtctctaataaaaatacgaaaaattagctgggcatggtggcgcacacctgtaatctcagctactcgggaggctgaggcaggagaatcccttgaacccaggaggcagaggttgcaatgagccaagatggtgtgattgcactccagcccaggggacaatgtgagactctgtctcaaaaaaaaaaaaaaatttgttgtagtagtccaggtgtccgggtgttgttaccagggcacccatgatgaaataactgggagagtccttttttctgactggttttcttcagtccctttatctacaggcacaactgctgaagaaaccagatggcctgggatggcaccagagcttttttacccttgaccagatactagagggaattaagaccccacaagtgggcacgaactggaactggcgacccctagttgccttcagatcattaacacatcattataatgctaaaattccctgccattttgtgaacatgggttgcatgaagacgtaagtttatgaattgcctctgcacacctagagtcccaccctgtacaggctaacattcctccctacatgcacccccccacaaacacaccctgcctcccccagtccttagaaaccctatgcctggccgggcgcagtggctcacgcctgtaatcccagcactttgggaggctgaggcgggcggatcactaggtcaggagatcgagaccatcctggctaacacggtgaaaccctgtctttactaaaaatc

SEQ ID NO: 29 - DNA, 2016 bp, Artificial Sequence
  Description of Artificial Sequence: Synthetic polynucleotide
atggaggccgagggcctggactggctcctggtgccactgcaccagctggtgtcctggggcgcggccgcggccatggtcttcggaggggtggtgccctacgtcccgcagtatcgggacattcgcaggacgcagaacgccgacggcttctccacctacgtgtgcctggtgctgctggtggccaacattttgcggatactcttctgagtcttgctctgtcgcccaggctggagtgcagtggtgcgaccttggctcactggtttggggcatgttcctgggtgtgtctgtgaggagcaagaaagccagttcaagtcccaaaacctcaaaagtagggaagccgacagggcagccttaagtctgtggctgaaggcctgagagaccctggcaaatcactgatataagtccaaaagctgaagaacttggaatctgatgttggaatctgatcttggcccatccttgaagaatctgggggtaataaataccctgaacattgatgaacccaaagggaagccagaaggtcagatgtcagctgtcgggaagaaaggctggataggaaataggaaaaagcagggcaaacaaggagcttcaaggactgaaacccttaagaaccacttgactctgtctctcaccacctccagccttgatgacacggtgacatatagaagaactgatgccctttgctttgagctgcacaaaaacctggcgctggacttggagaagctgaaagacaggacccggcaggagcctgaggagctgcaggctgctagcctgtagaccaccgtgctgtgttagccactgcagctgggaccattctgacactcagagcctggaaatggctgctccctcctgcctgctatccaagtatcctgtggatacttggcttttctcttgtgggcaacactaacctgaaactctttggggaagggaattgaggaaatgtagttccaagattagccaatttaactcagcataaacccatcacagggtttgactacagagttataacgttattctgtaggcaatgaaaacagaagtttttgaaaaaggcatcaatttgatgaaattgatattttggggaagattaatcttctgctgagtaaaatataacaggttggaggaagatgaaaatggagagagtagagtgtaattaaaagtttgttggaggccgggcacgggattacggctcactcctgtaatcccagcactttgggaggctgaggtgggcggatcacctgaggtcaggagcttgagatcatcccggccaacatagtgaaaccctgtctctaataaaaatacgaaaaattagctgggcatggtggcgcacacctgtaatctcagctactcgggaggctgaggcaggagaatcccttgaacccaggaggcagaggttgcaatgagccaagatggtgtgattgcactccagcccaggggacaatgtgagactctgtctcaaaaaaaaaaaaaaatttgttgtagtagtccaggtgtccgggtgttgttaccagggcacccatgatgaaataactgggagagtccttttttctgactggttttcttcagtccctttatctacaggcacaactgctgaagaaaccagatggcctgggatggcaccagagcttttttacccttgaccagatactagagggaattaagaccccacaagtgggcacgaactggaactggcgacccctagttgccttcagatcattaacacatcattataatgctaaaattccctgccattttgtgaacatgggttgcatgaagacgtaagtttatgaattgcctctgcacacctagagtcccaccctgtacaggctaacattcctccctacatgcacccccccacaaacacaccctgcctcccccagtccttagaaaccctatgcctggccgggcgcagtggctcacgcctgtaatcccagcactttgggaggctgaggcgggcggatcactaggtcaggagatcgagaccatcctggctaacacggtgaaaccctgtctttactaaaaatc

SEQ ID NO: 30 - DNA, 12895 bp, Artificial Sequence
  Description of Artificial Sequence: Synthetic polynucleotide
atggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagggtcttctgaagacggccctggatttccacaaactgggaaaggtggagttcagcggcgtcagagggaatgctctgagtcagcaggtccagcaaatgcatgaagaatttcaagagatgtacaggcttctctcaggatcctcctccgactgcctgtacctccaaagcacggactttgaaaatgacgtctctgaatttaaccagaaagtagaagatcttgaccgaagattggggactatctttattcaagcttttgatgatgcacctggcttggagcatgcctttaagctgctagacatagcaggaaacctccttgaaagaccgctggtagcgagggatacatctgataaatacctggtcctcatccaaatgttcaacaaagatctggatgcagtgaggatgatctacagtcagcacgtccaggaggaagcagaacttgggttctccccggtgcacaagaacatgcccaccgtggctggcggcctccgctgggcacaggagctgaggcagcgcatccagggtcctttcagcaactttggacgcatcacacacccttgcatggaatctgcagaaggaaagcgaatgcaacaaaaatatgaagatatgctgtcattgctagaaaagtatgagacaagactttatgaggattggtgccggacagtatcagagaagtcacagtacaatctttcccaaccacttctaaaacgtgacccagagacgaaggagatcactatcaactttaacccacagctgatttcagtgctgaaagaaatgagctatcttgaacccagagagatgaaacacatgcctgagacagcagcagccatgttctcctccagggatttctatcggcagcttgtggctaatttagagttgatggcaaattggtacaacaaggttatgaaaactctgctggaggtggaatttccattagtggaggaagagctgcaaaatattgatctccgcctcagagcagcagaggagactttgaactggaaaacagaaggcatttgcgattatgtcactgaaatcaccagtagtattcatgatcttgaacaaagaattcagaaaactaaagacaatgtggaagagatccaaaacatcatgaaaacatgggtgactccaatatttaagacaaaagatggaaaaagggaatcccttctttctctggatgatcggcatgatcgaatggaaaaatattacaatctcatcaaggaatctggccttaagatccacgcccttgttcaggaaaacctgggtctattttcagcagacccaacctccaatatctggaagacttatgttaactctattgacaatttgttgctgaatggattctttcttgccattgagtgctccctcaagtatcttctggaaaatactgagtgtaaggcaggacttaccccaatatttgaagcacaactgagtctagccatcccagagctagttttctatccgtctctggagtctggagtgaaggggggtttctgtgacattgttgagggtctcatcaccagcatttttaggataccatctctggtgccacggctttccccacaaaatggctctcctcactatcaggtcgacctggacggtataccagatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcactccggaagaaattgaagaccatgtggaagatggcatcccagagaaccctcccctcctttctcagtttaaagtgcaaatcgactcctatgaaacgctctatgaagaggtgtgcaggctggaacccatcaaggtgtttgacggctggatgaaaattgatattcgaccctttaaggcatctctgctgaatattattaagaggtggagcctcctgttcaaacagcatcttgtggaccacgtcactcacagcttggccaacctggatgcgtttataaagaagagtgagagcggcttactcaagaaagttgaaaaaggagatttccaaggcttggttgagatcatgggacaccttatggctgttaaagaacggcagagtaacactgatgagatgtttgagcccttaaagcagactattgaattgctgaagacctatgaacaagaattgccagaaacagtgtttaagcagctggaggagctgcctgagaaatggaacaacataaaaaaggtggccattactgtgaagcagcaggtggccccactgcaggcaaatgaagtgacactcctccgccagaggtgcacagccttcgatgcagaacagcagcaattctgggagcaattccacaaagaagccccgttcaggtttgatagcatccaccctcatcaaatgctggatgccaggcacatcgagatccagcagatggaatccactatggcctccatttctgagtctgccagcttatttgaagtcaatgtccctgactataagcagctgaggcagtgcaggaaggaggtctgccagctgaaggagctctgggacaccattggaatggtgacctccagcatccatgcctgggagaccacaccctggaggaatatcaacgtggaagccatggagttggagtgcaaacagtttgcccggcatatccgaaacctggacaaggaggtcagggcctgggatgcattcacaggcctggaaagcactgtgtggaacacgctgagctccctgagggcagtagctgagctgcagaatccagccatccgggagcggcactggaggcagctgatgcaggccaccggtgtgagcttcactatggaccaggacaccaccctagcgcacctgctgcagctccagctgcaccactatgaggatgaggtccggggcattgtggacaaagctgcaaaagagatgggtatggagaaaaccttaaaggagctgcagactacctgggctggcatggaattccagtatgagccccacccacggaccaatgtccccctcctgtgctctgatgaggacctcatagaggttctggaggataatcaagttcaacttcagaacctggtgatgtccaagtatgttgctttcttcttggaggaggtgtcgggctggcagaagaagctgtccacagtggacgctgtcatctctatctggtttgaagtgcagcgaacatggactcacctggaaagcatattcactggatctgaagatattcgggcacagctaccccaggattctaaaaggtttgaaggcatcgacattgactttaaagagctagcttatgatgcccagaaaattccaaatgtagtgcaaaccaccaacaagccaggcctgtatgaaaagctggaggatattcagggcagattgtgcctgtgtgagaaggccctggcagagtacctcgacaccaagaggcttgccttcccgcggttttactttctctcctcctccgatctgttagacatcctttccaacggcacagctccacaacaggttcaacgtcacctttccaaactctttgacaacatggccaagatgcgattccagctagatgccagtggggaaccaaccaagacaagcctcggcatgtacagcaaagaagaggagtatgtggctttcagtgagccctgtgactgcagcgggcaggtagaaatatggctgaaccatgtccttggtcacatgaaggccactgtgaggcatgagatgacagaaggtgtaactgcctatgaagaaaagccgagggagcagtggctttttgaccacccagctcaggtggccctgacctgtactcagatctggtggacaacagaagtgggcatggcatttgccaggctggaggaaggctatgagagtgccatgaaggactattataagaagcaagtggcccagctcaaaacccttatcaccatgctgattggccagctctccaagggagaccggcagaagattatgactatatgcaccatcgatgtgcatgcccgggatgtggtagccaagatgattgctcagaaggtagacaatgcccaggctttcctctggctgtctcagctgcgccatcgttgggatgacgaggtcaaacactgctttgccaacatctgtgatgcccagtttttgtattcctatgagtacctgggaaacacacctcgcttggtgatcacacctttgactgacaggtgctacatcaccctcacccagtccctgcacctgaccatgagtggggctcccgcaggacctgcaggcacaggcaagaccgagaccaccaaggacctgggccgcgcactgggcatcctggtctatgtgttcaactgctcggagcagatggattacaagtcttgtggcaacatctacaaaggccttgctcagactggtgcctggggctgctttgatgagtttaatcgaatctccgtggaggtcttgtcagtggtggcagtgcaggtaaaaagcattcaagatgcgattagagataagaagcagtggttcagcttccttggggaggagatcagcctgaatccttctgtcggtatcttcatcaccatgaacccaggctatgctggccgcacagagctgccagagaatctcaagtctctcttcaggccttgtgcaatggtggttccagactttgaattgatctgtgaaatcatgctggtggcagaaggattcattgaagcccagtcattagccagaaagttcatcactctttaccagttgtgcaaagagcttctctccaaacaggatcactacgactggggcctacgggccatcaagtccgtgctggtggtggcaggatccctgaagagaggagaccctgaccggcctgaggaccaggtcctgatgcgctccttgcgggatttcaacatccccaagattgtgactgatgacatgcccatcttcatgggcctgatcggggacctctttcccgccctggatgtcccccggaggagagaccccaacttcgaagctttggttaggaaggcgatagtggatctgaagctccaggctgaggacaactttgtgctcaaggtggtccagctggaggagctcctggctgtgcggcactctgtatttgtggtgggtggcgctggtaccggcaagtcacaggtgctgaggtccttgcacaagacctatcagatcatgaaacggcgccccgtctggactgacctcaatcccaaagcagtcacaaatgatgagctctttggcatcatcaatccagccacaggagaatggaaggatggattgttctcttccatcatgcgggagcttgccaacatcacccatgatgggcccaagtggattttactggatggcgacatagatccaatgtggattgaatccctgaatactgtcatggatgataacaaggtgctgacattggccagcaatgagaggattcctctgaaccccaccatgaagctcctctttgagatcagccacctgcgcacagccactccagcaactgtctctagagcagggatcttgtacatcaacccggcagacttgggatggaaccctccagtgagcagctggattgagaagagggaaatccagacagagagagccaacttaaccattttgttcgacaagtatcttccaacctgcctagacacactcagaaccaggtttaagaagatcattcccatcccagagcagagcatggttcagatggtgtgtcaccttctggaatgtctcctgaccacggaggacatccctgcagactgccctaaggaaatttatgagcattattttgtgtttgctgccatctgggctttcggcggagcaatggtccaagatcagcttgtggactaccgggcagagttcagcaaatggtggctgactgagttcaaaacagtcaagtttccttcccaaggaaccatctttgactattacatcgacccagagaccaagaaattcgagccttggtccaagctcgtcccccagttcgaatttgaccccgagatgcccttgcaggcgtgtttggtgcacacgagtgagaccatccgtgtgtgctacttcatggagcggttgatggcgcggcagcggcctgtcatgctggtgggcacggctggcactggcaagtcggtgctggtgggagctaagctggccagccttgaccccgaggcatacctggtgaaaaacgtgccattcaactactacaccacgtcagcaatgctgcaggctgtcctggagaagcctctggaaaagaaggctggcagaaactatggccctccagggaacaagaaactcatctatttcattgatgacatgaacatgcctgaggtggatgcctacgggacggtgcagccccacaccatcatccggcagcatctggactatggccactggtatgatcggagcaagctgtccctaaaggagatcacaaatgtacagtatgtttcctgtatgaaccccacggcaggcagcttcaccatcaacccccggcttcagcgtcacttcagcgtgtttgtcctctccttcccgggggcagatgccctgtcctctatctacagcatcatcctcactcagcatctgaagctcggaaacttcccggcgtccctgcagaaatccatccccccactgatcgatctggccctcgccttccaccagaaaattgctaccaccttcctacccacaggaatcaaattccactacatcttcaacctcagagattttgccaacattttccagggcattctcttctcctcagtggaatgtgtgaaatccacatgggatcttataaggctctatctgcatgaatcaaatcgagtttatcgggataagatggtagaagaaaaggactttgatctttttgataaaatccagacagaagtgctcaagaaaacttttgatgatattgaagaccctgtggagcagacccaaagcccgaacctgtattgtcactttgcaaatggtattggggagcccaaatacatgcctgtacagtcttgggaacttttgacccagactctggtggaggccttggagaaccacaatgaagtcaacacagtgatggacctagttctctttgaggatgccatgcgccatgtctgccatatcaatcgcatcttggagtccccgcggggaaatgctctgctggttggtgtaggtgggagcggcaagcagagcctgacaaggctggcagctttcatcagctccatggatgtcttccagatcacactgcgcaaaggctaccagatccaggacttcaagatggacctggccagcctgtgtctgaaagctggagtgaagaatctcaacacagtgtttctcatgactgatgcccaagtggctgatgagaggttccttgtgctcatcaatgatcttttggcatctggggagatcccagatctctactctgatgatgaagttgaaaacatcataagcaatgtgaggaatgaagtcaagagccagggtctggttgacaacagagagaactgttggaagttctttatagatcggatccggcgacagctgaaggtgactctctgtttctcccctgtgggaaacaagctaagagtccgcagcaggaagttcccagccattgtgaactgcacagccatccactggttccacgagtggcctcagcaagcattggagtctgtcagcctccgcttcttgcagaacacagagggcattgagcccacagtaaagcagtcgattagcaaattcatggcctttgtccacacaagtgtcaaccaaacatcccagtcttatctgagcaatgaacagcgctacaactatacaactcccaagtcctttctggagttcatcagactctaccagagcttgttgcacaggcacagaaaagagctcaagtgcaagacagagcggttggagaacgggctgctgaagctgcatagcacctctgcccaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagaccccgagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaagtccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcagaacattcacctggtggccaagtggctcagcaccctggagaagaagctggaggagcacagtgagaacagccacccagagttcagggtcttcatgagtgcagagccagcaccctcccctgagggccacatcatcccccagggcatcctggagaactccattaagatcaccaatgagccccccacgggcatgcatgccaacctgcacaaggccctggacaacttcactcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttag

SEQ ID NO: 31 - DNA, 620 bp, Artificial Sequence
  Description of Artificial Sequence: Synthetic polynucleotide
atgggggatgccaaggaggccggagccgagggtccgccggccggggccgccgctcgaggagggctcagcctcctgtcccagggagaatccgaggaatcttctgcacagggatcagctttatttcttggaggcaatgaagtgaagagccgagctgtggtgaaatactcttctgcccctcctcgaacagcatttgcacgccttgaagagaaaacagacttgaaactcccacctgccaactggttacgagagagtgccaaactagggccagcaggaactaccattcttggcaacagcaagaaaagcaagccattttcaagctttggcatggcatatgactttattgattcagtgggaaatgatgtggatgttgtctctgactctgaagtgaggagaagatgctgttctgagagctgctgataatacgtggatccaaacccacaggcttgagctgcttaattgaaattcacgtcaaaatgaaattctggtttagctcaacttgactactatggatgatgaaaataaatccctgggtcacacaaggatagtgattgagtagagcttgtttgctggcacaggaatgacatttcaactggaattaaattgtcgtcagttaacagaac

SEQ ID NO: 32 - DNA, 2547 bp, Artificial Sequence
  Description of Artificial Sequence: Synthetic polynucleotide
atgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttggaaaatctacttcctcatcaagcacccctacagagttctgcaggaatggtggaacctgggaaaatggcagatgtatttgtacagaagagtggaaaggactgagatgtacaattgctaatttttgtgaaaatagtacctatatgggttttacttttgccagaatcccagtgggcagatatggaccatccttgcaaacatgtggcaaggatactccaaatgcgggcaatccaatggcagtccggttgtgcagtctctctctatatggagagatagaattacaaaaagtgacaataggaaattgcaatgaaaatctggaaaccctggaaaagcaggtaaaggatgtcacagcaccacttaataacatttcttctgaagtccagattttaacatctgatgccaataaattaactgctgagaacatcactagtgctacgcgagtggttggacagatattcaacacttccagaaatgcttcacctgaggcaaagaaagttgccatagtaacagtgagtcaactcctagatgccagtgaagatgcttttcaaagagttgctgctactgctaatgatgatgcccttacaacgcttattgagcaaatggagacttattccttgtctttgggtaatcaatcagtggtggaacctaacatagcaatacagtcagcaaatttctcttcagaaaatgcggtggggccttcaaatgttcgcttctctgtgcagaaaggagctagcagttctctagtttctagttcaacatttatacatacaaatgtggatggccttaacccagatgcacagactgagcttcaggtcttgcttaatatgacgaaaaattacaccaagacatgcggctttgtagtttatcaaaatgacaagcttttccaatcaaaaacttttacagctaaatcggattttagtcaaaaaattatctcaagcaaaactgatgaaaatgagcaagatcagagtgcttctgttgacatggtctttagtccaaagtacaaccaaaaagaatttcaactctattcctatgcctgtgtctattggaatttgtcagcgaaggactgggacacatatggctgtcaaaaagacaagggcactgatggattcctgcgctgccgctgcaaccatactactaattttgctgtattaatgactttcaaaaaggattatcaatatcccaaatcacttgacatattatccaacgttggatgtgcactgtctgttactggtctggctctcacagttatatttcagattgtcaccaggaaagtcagaaaaacctcagtaacctgggttttggtcaatctgtgcatatcaatgttgattttcaacctcctctttgtgtttggaattgaaaactccaataagaacttgcagacaagtgatggtgacatcaataatattgactttgacaataatgacatacccaggacagacaccattaacatcccgaatcccatgtgcactgcgattgccgccttactgcactattttctgttagtgacatttacctggaacgcactcagcgctgcacagctctattaccttctaataaggaccatgaagcctcttcctcggcatttcattcttttcatctcattaattggatggggagtcccagctatagtagtggctataacagtgggagttatttattctcagaatggaaataatccacagtgggaattagactaccggcaagagaaaatctgctggctggcaattccagaacccaatggtgttataaaaagtccgctgttgtggtcattcatcgtacctgtaaccattatcctcatcagcaatgttgttatgtttattacaatctcgatcaaagtgctgtggaagaataaccagaacctgacaagcacaaaaaaagtttcatccatgaagaagattgttagcacattatctgttgcagttgtttttggaattacctggattctagcatacctgatgctagttaatgatgatagcatcaggatcgtcttcagctacatattctgccttttcaacactacacagggattgcaaatttttatcctgtacactgttagaacaaaagtcttccagagtgaagcttccaaagtgttgatgttgctatcgtctattgggagaaggaagtcattgccttcagtgacgcggccgaggctgcgtgtaaagatgtataatttcctcaggtcattgccaaccttacatgaacgctttaggctactggaaacctctccgagtactgaggaaatcacactctctgaaagtgacaatgcaaaggaaagcatctag

SEQ ID NO: 33 - DNA, 1720 bp, Artificial Sequence
  Description of Artificial Sequence: Synthetic polynucleotide
atggaggcagcgccgcccgggccgccgtggccgctgctgctgctgctgctgctgctgctggcgctgtgcggctgcccggcccccgccgcggcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttcttccacactcgctgtgaggaggacaatggcggctgctcccacctgtgcctgctgtccccaagcgagcctttctacacatgcgcctgccccacgggtgtgcagctgcaggacaacggcaggacgtgtaaggcagcttgtgagatccaccatgaagaaggagttggatgcagtccgaattaaaacatccattttttccctgttccgtgcacccaaattgcgaatgagagtcttcggcctgtgctttgtgagattcgcaatcactgtacccttttatggcctgatactcaacttgcagcacttagggagcaatgtctccctgttccagattctctgtggagctgtcacattcacagccagatgtgtttcccttttgacactgaatcatatgggtcgtcgaataagccagatattgttcacgttcccggtgggacttttcattctggtcaacacctttttgccccaagaaatgcagatcctgcgtgtggttttagcaactttgggaattggtagtgtttctgctgctagcaacagtgcttctgtccaccacaacgagctcgtccccaccatattgaggtcaacagttgcaggaatcaatgcagtgtccggtaggactggggcagcactggctcctctgttgatgaccttaatggcgtattctccccacctaccctggatttcctatggagtcttccccatccttgctgtccctgttatcctcctccttccagaaaccagggatctacctcttcctaacaccatccaggatgtggaaaatgacagaaaagattcaagaaacataaagcaggaagatacttgcatgaaagtaacacagttttaa

SEQ ID NO: 34 - DNA, 1044 bp, Artificial Sequence
  Description of Artificial Sequence: Synthetic polynucleotide
agcggacatcatttccaccgttgagtttaattactctggagatcttcttgcaacaggagacaagggcggcagagttgttatttttcagcgtgaacaagagaataaaagccgccctcattctaggggagaatataatgtttacagcacctttcaaagtcatgaaccggagtttgactatttgaaaagtctagaaattgaggaaaaaattaataaaattaggtggttaccacaacagaatgctgctcattttctactgtctacaaatgataaaactataaaattatggaaaataagtgaacgggataaaagagcagaaggttataacctgaaagacgaagatggaagacttcgagacccatttaggatcacggcgctacgggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagggttattttggagccgttggggcactgttggaactgttcaaaatgactgatgacaagtag

SEQ ID NO: 35 - DNA, 5500 bp, Artificial Sequence
  Description of Artificial Sequence: Synthetic polynucleotide
atgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtgtatgaacaggatgatctgagtgaacaaatggcaagtttggaaggactcatgaagcagcttaatgccatcacaggctcagccttttaa

SEQ ID NO: 36 - DNA, 1787 bp, Artificial Sequence
  Description of Artificial Sequence: Synthetic polynucleotide
atggcatcggtcaaggtggccgtgagggtccggcccatgaatcgcagcttccctttgctgaaggtctgtaccacttttatcacaatggccttgcaaaggccaagagaagacgcagcctacaccacaagcagcagctggagagagaccccagggtaaagatggctttgcagcaggaaggatttgaccgaaaaaagcgaggttacagagacatcaatgagatcgacatcaacatgaacgatcctctttttacaaagcagtggtatctgatcaatactgggcaagctgatggcactcctggccttgatttgaatgtggctgaagcctgggagctgggatacacagggaaaggtgttaccattggaattatggatgatgggattgactatctccacccggacctggcctccaactataatgccgaagcaagttacgacttcagcagcaacgacccctatccttaccctcggtacacagatgactggtttaacagccacgggacccgatgtgcaggagaagtttctgctgccgccaacaacaatatctgtggagttggagtagcatacaactccaaggttgcaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggcaaccacagatttgtacggcaactgcactctgaggcattctgggacatctgcagctgcccccgaggcagctggtgtgtttgcactggctctggaggctaacctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactag

SEQ ID NO: 37 - DNA, 1200 bp, Artificial Sequence
  Description of Artificial Sequence: Synthetic polynucleotide
gtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcgggccgatgtccattggaatcactgtgatgctgatcatacacaactatttgttcctttacatcccttatttgatgtggctttactttgactggcataccccagagcgaggaggcaggagatccagctggatcaaaaattggactctttggaaacactttaaggactattttccaattcatcttatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgatgagtgttgggctggtttcagtttccaagaaaagtgtgtcctacatggtaagcaaggagggaggtggaaacatctctgtcattgtccttgggggtgcaaaagaatcactggatgctcatcctggaaagttcactctgttcatccgccagcggaaaggatttgttaaaattgctttgacccatggcgcctctctggtcccagtggtttcttttggtgaaaatgaactgtttaaacaaactgacaaccctgaaggatcatggattagaactgttcagaataaactgcagaagatcatggggtttgctttgcccctgtttcatgccaggggagtttttcagtacaattttggcctaatgacctataggaaagccatccacactgttgttggccgcccgatccctgttcgtcagactctgaacccgacccaggagcagattgaggagttacatcagacctatatggaggaacttaggaaattgtttgaggaacacaaaggaaagtatggcattccagagcacgagactcttgttttaaaatgacttgactataaaaaaaaattaaaaaataaaaataaatgact

SEQ ID NO: 38 - DNA, 1680 bp, Artificial Sequence
  Description of Artificial Sequence: Synthetic polynucleotide
atggagccccagcgccgggagctgctcgcccagtgtcagcagagcctggcccaggccatgacggaggtggaagccgtgctcgggctgctcgaggccgcgggagcgctcagtcccggcgagcggcggcagctggacgaggaggcgggaggcgccaaggcggagctgctgctcaagctgctcttggccaaggagcgggaccacttccaggacctgcgggcggcgctggagaagacgcagcctcacctgctgcccattctctacctgaacggcgtcgtcgggccgccgcagcccgccgaaggcgcgggttctacctacagcgtcctgtccaccatgccctcagactcagaaagcagcagctccctcagcagtgtgggcactaccgggaaggcgccgtccccaccacccctcctcactgaccagcaagtgaatgagaaggtggagaacctctccattcagctgcggctgatgacccgggagagaaacgagctccgcaagcgcctggcctttgctacgcatggcacggcctttgacaagaggccctaccacaggctgaatcctgactatgagaggctgaagatccagtgcgtgcgagccatgtcggacctgcagagcctgcagaaccagcacaccaacgccttgaagaggtgtgaggaggtggccaaggagactgacttctaccacacactccacagccggctcctgagtgaccagactcggctgaaggatgacgtggacatgctgaggcgggagaatgggcagctgctgcgggagcgaaacctgctgcagcagtcatgggaggacatgaagcggctccacgaggaggaccagaaggagatcggtgacctccgtgcccagcagcagcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactga

SEQ ID NO: 39 - DNA, 2279 bp, Artificial Sequence
  Description of Artificial Sequence: Synthetic polynucleotide
atgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacagcccctctgactgataagccacccaagcttttgtatcctatggaaagtaaactgacaattcaggagacccagctgggtgactctgctaatctaacctgcagagctttctttgggtacagcggagatgtcagtcctttaatttactggatgaaaggagaaaaatttattgaagatctggatgaaaatcgagtttgggaaagtgacattagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgagagctaatgtacacagtggaacttgctggaggccttggtgctatactcttgctgcttgtatgtttggtgaccatctacaagtgttacaagatagaaatcatgctcttctacaggaatcattttggagctgaagagctcgatggagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaacatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtga

SEQ ID NO: 40 - DNA, 2010 bp, Artificial Sequence
  Description of Artificial Sequence: Synthetic polynucleotide
atggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagccatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 41 - DNA, 2388 bp, Artificial Sequence
  Description of Artificial Sequence: Synthetic polynucleotide
atggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 42 - DNA, 1876 bp, Artificial Sequence
  Description of Artificial Sequence: Synthetic polynucleotide
atggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacgaggaacgagtacctgctgacggtggtggcagaggagagcgacctgctgctgctcggcctgcggttgtcacctgcccagctgcacttcctgttccttcgcgaggacacggccggcgcctggcagacccgagtgtccttccgcagcccggccctggtggatggccgctggcacacactggtcctggctgtgtccgcaggcgtcttctccctcaccacggactgcggcctcccggtggacataatggccgatgtgcccttcccagccaccctgtcagtgaaaggagctcgattcttcgtcggcagccggaggagagccaaaggcctgttcatgggactggtgaggcaactggtcctgctgccgggctcagacgccaccccaaggctgtgtcccagcaggaacgccccgctggcggtgctgtccatcccacgggtcctgcaggctctcacggggaagccagaagataacgaggtgctaaaatatccctatgaaaccaacattcgagtgacgctgggaccccagccaccgtgtaccgaggtggaagacgcccagttctggtttgatgccagccggaagggcctgtatctgtgtgttggcaacgagtgggtctccgtgttagcagccaaagaaagactggactacgtggaggagcatcagaacttgtccaccaactcagagaccctgggcattgaggtgttccgcatccctcaggtggggctctttgtggccacagccaatcgcaaagccacatccgccgtctacaagtggaccgaagagaagttcgtctcatatcagaacatccccacgcaccaagcacaggcctggaggcatttcaccatcgggaaaaagatcttcctggcagtggctaattttgaaccagatgagaagggtcaggagttctctgtcatttacaaatggagccacagaaagctgaagtttaccccatatcagagcattgccacacacagcgcccgagactgggaggccttcgaggtggatggggagcacttcctggcggtggccaaccaccgggaaggcgacaaccacaacatcgacagtgtcatctacaagtggaacccggcaacccggctcttcgaggccaaccagaccatcgccacctccggcgcctacgactgggagttcttcagtgtggggccctactcgttcctggtggtggccaacaccttcaacggcacctccaccaaggtgcactcgcacctctacatccgactcctgggctccttccagctcttccagtccttcccgacgttcggtgctgcagactgggaggtcttccagatcggggagaggatcttcctcgctgtggcaaacagtcacagctacgatgtggagatgcaagtccagaatgattcctatgtcatcaactccgtcatctacgagctgaacgtgaccgcgcaggcctttgtcaagttccaggacattctcacctgcagtgctctggactgggagtttttctcggtgggagaagattatttcctggtggtggccaactccttcgatgggcgtaccttctcggtgaacagtattatttacaggtggcagggctacgagggcttcgtggcggtgcacagcctccccaccgtcggctgcagggactgggaggccttcagcaccacggctggtgcctacctcatctactccagcgccaaggagcccctctccagggtcctgcggctgaggacacgctga

SEQ ID NO: 43 - DNA, 1354 bp, Artificial Sequence
  Description of Artificial Sequence: Synthetic polynucleotide
atgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgatgtctacagtgatatgtatgaaacaaagggaagaagaattcttgctaaccatcagaccttttgcaaacaggatgcagaaatccccttgctatattcccattgtgagcagtgccaccctgtgggatagaagcacacccagtgcaaagcacatcccttgttatgaaagaacttcagtaccctgctccagattcattaatcacatgaagaatttctctgaatctcctaaatttcgtagtctacactttctgaattttccagtatttccagaaaggactcaaaattcaatggcgtgtaaaagactacttcatacttgccagtacatagtccccaggtgttctgtaagcacagtttcttttgatgaagaaagctatgaagaattccgttcctctccagcaccatccagtgaaactgatgaggccccattgatttttactgccagaggagaaactgaggagagagccagaggagcacccaagcaggcttggaacagttcatttttggaacaactggttaaaaagcctaactgggcacactcagtaaatcctgttcacctggaggctcagggcatacacatcagtagacacacaagacctaagggccagcccttgagcagtcccaagaaaaattctggttctgccgccagaccttccactgccatcggcctctgcaggaggagccagacgcccggcgctctgcagagcaccggcccgagtaacacagagctcgagccggaggagaggatggcagtcccagcaggcgctcaggcacaccccgacgacatccaaagcagactcctgggcgcgtccggaaatcccgtcggaaaaggcgcggttgccatggcgccggagatgctccccaagcatcctcataccccgcgggacaggaggcctcaggcggacacctccctccatggcaatctggcaggagcgccccttcctctgctggccggtgcttccacccatttcccctccaagaggttaataaaggtttgctcctcagcacccccccgcccaacccggcgtttccatacggtttgttcacaggccctttctaggccggtggtgaatgctcacttacattga

SEQ ID NO: 44 - DNA, 693 bp, Artificial Sequence
  Description of Artificial Sequence: Synthetic polynucleotide
atgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagatacagatgctttgttctgtacaagctgcccaacttgaaatttctggatgcccagaaagtaaccagacaagaacgagaggaggcgttggtcagaggagtcttcatgaaggtggtgaagcccaaggcttctagtgaggacgttgccagctccccggagcgccactacacgcccttgccttctgcttccagggaactcaccagtcaccaaggtgtcctggggaagtgtcgctacgtttactatgggaaaaactcagagggcaacaggtttatccgagatgaccagctctga

SEQ ID NO: 45 - DNA, 1723 bp, Artificial Sequence
  Description of Artificial Sequence: Synthetic polynucleotide
ggtgagagaggccgggggcggggccgtgcggccggggacctgttgatcgcaggtatagccggctggcccgggctccctcgggactggggcgactgcgcatgctcgctggccgcgctgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaactttggtctgtgtatgtgtgtgtgttttactttaatatgaattatacaaaatactagttgttttacactctcttttcttattcttagggcttttgtgtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaattaatttattttcattttcagaaatatatgcatgcagttatgttttatttgattgttgacttaggctatgtctgtatacagtaaccaaataaactctttcactattaaagagatttcttactgac

SEQ ID NO: 46 - DNA, 439 bp, Artificial Sequence
  Description of Artificial Sequence: Synthetic polynucleotide
atgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtggggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtga

SEQ ID NO: 47 - DNA, 4234 bp, Artificial Sequence
  Description of Artificial Sequence: Synthetic polynucleotide
atgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcagcactggaagacgcaacgcagtgaggagtatgaagcggaaggccagttaaggttttggaacccagatgacttgaatgcttcacagagtggatcttcccctccccaagactggatagaagagaaactgcaagaagtttgtgaagatttggggatcacccgtgatggtcacctgaaccggaagaagctggtctccatctgtgagcagtatggtttacagaatgtggatggagagatgctcgaggaagtattccataatcttgatcctgacggtacaatgagtgtagaagattttttctatggtttgtttaaaaatggaaaatctcttacaccatcagcatctactccatatagacaactaaaaaggcacctttccatgcagtctttcgatgagagtggacgacgtaccacaacctcatcagcaatgacaagtaccattggctttcgggtcttctcctgcctggatgatgggatgggccatgcatctgtggagagaatactggacacctggcaggaagagggcattgagaacagccaggagatcctgaaggccttggatttcagcctcgatggaaacatcaatttgacagaattaacactggcccttgaaaatgaacttttggttaccaagaacagcattcaccaggcggctctggccagctttaaggctgaaatccggcatttgttggaacgagttgatcaggtggtcagagaaaaagagaagctacggtcagatctggacaaggccgagaagctcaagtctttaatggcctcggaggtggatgatcaccatgcggccatagagcggcggaatgagtacaacctcaggaaactggatgaagagtacaaggagcgaatagcagccttaaaaaatgaactccgaaaagagagagagcagatcctgcagcaggcaggcaagcagcgtttagaacttgaacaggaaattgaaaaggcaaaaacagaagagaactatatccgggaccgccttgccctctctttaaaggaaaacagtcgtctggaaaatgagcttctagaaaatgcagagaagttggcagaatatgagaatctgacaaacaaacttcagagaaatttggaaaatgtgttagcagaaaagtttggtgacctcgatcctagcagtgctgagttcttcctgcaagaagagagactgacacagatgagaaatgaatatgagcggcagtgcagggtactacaagaccaagtagatgaactccagtctgagctggaagaatatcgtgcacaaggcagagtgctcaggcttccgttgaagaactcaccgtcagaagaagttgaggctaacagcggtggcattgagcccgaacacgggctcggttctgaagaatgcaatccattgaatatgagcattgaggcagagctggtcattgaacagatgaaagaacaacatcacagggacatatgttgcctcagactggagctcgaagataaagtgcgccattatgaaaagcagctggacgaaaccgtggtcagctgcaagaaggcacaggagaacatgaagcaaaggcatgagaacgaaacgcacaccttagaaaaacaaataagtgaccttaaaaatgaaattgctgaacttcaggggcaagcagcagtgctcaaggaggcacatcatgaggccacttgcaggcatgaggaggagaaaaaacaactgcaagtgaagcttgaggaggaaaagactcacctgcaggagaagctgaggctgcaacatgagatggagctcaaggctagactgacacaggctcaagcaagctttgagcgggagagggaaggccttcagagtagcgcctggacagaagagaaggtgagaggcttgactcaggaactagagcagtttcaccaggagcagctgacaagcctggtggagaaacacactcttgagaaagaggagttaagaaaagagctcttggaaaagcaccaaagggagcttcaggagggaagatatgaatctgaaaagcttcaacaggaaaattctattttgagaaatgaaattactactttaaatgaagaagatagcatttctaacctgaaattagggacattaaatggatctcaggaagaaatgtggcaaaaaacggaaactgtaaaacaagaaaatgctgcagttcagaagatggttgaaaatttaaagaaacagatttcagaattaaaaatcaaaaaccaacaattggatttggaaaatacagaacttagccaaaagaactctcaaaaccaggaaaaactgcaagaacttaatcaacgtctaacagaaatgctatgccagaaggaaaaagagccaggaaacagtgcattggaggaacgggaacaagagaagtttaatctgaaagaagaactggaacgttgtaaagtgcagtcctccactttagtgtcttctctggaggcggagctctctgaagttaaaatacagacccatattgtgcaacaggaaaaccaccttctcaaagatgaactggagaaaatgaaacagctgcacagatgtcccgatctctctgacttccagcaaaaaatctctagtgttctaagctacaacgaaaaactgctgaaagaaaaggaagctctgagtgaggaattaaatagctgtgtcgataagttggcaaaatcaagtcttttagagcatagaattgcgacgatgaagcaggaacagaaatcctgggaacatcagagtgcgagcttaaagtcacagctggtggcttctcaggaaaaggttcagaatttagaagacaccgtgcagaatgtaaacctgcaaatgtcccggatgaaatctgacctacgagtgactcagcaggaaaaggaggctttaaaacaagaagtgatgtctttacataagcaacttcagaatgctggtggcaagagctgggccccagagatagctactcatccatcagggctccataaccagcagaaaaggctgtcctgggacaagttggatcatctgatgaatgaggaacagcagctgctttggcaagagaatgagaggctccagaccatggtacagaacaccaaagccgaactcacgcactcccgggagaaggtccgtcagttggaatccaatcttcttcccaagcaccaaaaacatctaaacccatcaggtaccatgaatcccacagagcaagaaaaattgagcttaaagagagagtgtgatcagtttcagaaagaacaatctcctgctaacaggaaggtcagtcagatgaattcccttgaacaagaattagaaacaattcatttggaaaatgaaggcctgaaaaagaaacaagtaaaactggatgagcagctcatggagatgcagcacctgaggtccactgcgacgcctagcccgtcccctcatgcttgggatttgcagctgctccagcagcaagcctgtccgatggtgcccagggagcagtttctgcagcttcaacgccagctgctgcaggcagaaaggataaaccagcacctgcaggaggaacttgaaaacaggacctccgaaaccaacacaccacagggaaaccaggaacaactggtaactgtcatggaggaacgaatgatagaagttgaacagaaactgaaactagtgaaaaggcttcttcaagagaaagtgaatcagctcaaagaacaagtgagcctacccggtcatctctgttcacccacctcacattccagctttaactccagttttacatccctttattgccattaa

SEQ ID NO: 48 - DNA, 780 bp, Artificial Sequence
  Description of Artificial Sequence: Synthetic polynucleotide
atggctaaaagtgcggaggtcaaactggcaatatttgggagagcaggcgtgggcaagtcaggcagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggatggcccagctgaggctggtgctggggctccacaccctggacagccccggtctcaccttccacatcaaggcagccatccagcaccctcgctacaagcccgtccctgccctggagaacgacctcgcgctgcttcagctggacgggaaagtgaagcccagccggaccatccggccgttggccctgcccagtaagcgccaggtggtggcagcagggactcggtgcagcatggccggctgggggctgacccaccagggcgggcgcctgtcccgggtgctgcgggagctggacctccaagtgctggacacccgcatgtgtaacaacagccgcttctggaacggcagcctctcccccagcatggtctgcctggcggccgactccaaggaccaggctccctgcaagggtgactcgggcgggcccctggtgtgtggcaaaggccgggtgttggccagagtcctgtccttcagctccagggtctgcactgacatcttcaagcctcccgtggccaccgctgtggcgccttacgtgtcctggatcaggaaggtcaccggccgatcggcctga

SEQ ID NO: 49 - DNA, 2417 bp, Artificial Sequence
  Description of Artificial Sequence: Synthetic polynucleotide
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaaccaggtcccgccccccagcacccgagccctcctctacttcagccgactctgggaggatttcaaacagaacactcctttcctcaactggaaagcaattattgagggtgcggacgcgtcatcactgcagaaacgtgcaggcagagacgatcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctga

SEQ ID NO: 50 - DNA, 2485 bp, Artificial Sequence
  Description of Artificial Sequence: Synthetic polynucleotide
atgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacatatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtag

SEQ ID NO: 51 - DNA, 1868 bp, Artificial Sequence
  Description of Artificial Sequence: Synthetic polynucleotide
atgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttggaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaa

SEQ ID NO: 52 - DNA, 3751 bp, Artificial Sequence
  Description of Artificial Sequence: Synthetic polynucleotide
gcattacgcgccccacgcatcctcttccatccccaggcacagatcaaaggcgcagcccaggaggcgggagcccctgcacactttccacctctgctgggcttagcctcttggctggttggtctgtggagtgcctgaagtgaccagctttttgtaaggtcaactttgtagtgtgccaactctttgccttgctagcagccatttggtttcgaacttatctacattcaagcaaaactagctcttttataagacatgtagttgctacccttttgggcctttatcttgcacttttttgctttggatggtatgccttacactttcttgtacaaagtggaatttcctactgtatcatgatcatcataggagtggagaacatgcacaattactgctttgtgtttgctctgggatacctcacagtgtgccaagttactcgagtctatatctttgactatggacaatattctgctgatttttcaggcccaatgatgatcattactcagaagatcactagtttggcttgcgaaattcatgatgggatgtttcggaaggatgaagaactgacttcctcacagagggatttagctgtaaggcgcatgccaagcttactggagtatttgagttacaactgtaacttcatggggatcctggcaggcccactttgctcttacaaagactacattactttcattgaaggcagatcataccatatcacacaatctggtgaaaatggaaaagaagagacacagtatgaaagaacagagccatctccaaatactgcggttgttcagaagctcttagtttgtgggctgtccttgttatttcacttgaccatctgtacaacattacctgtggagtacaacattgatgagcattttcaagctacagcttcgtggccaacaaagattatctatctgtatatctctcttttggctgccagacccaaatactattttgcatggacgctagctgatgccattaataatgctgcaggctttggtttcagagggtatgacgaaaatggagcagctcgctgggacttaatttccaatttgagaattcaacaaatagagatgtcaacaagtttcaagatgtttcttgataattggaatattcagacagctctttggctcaaaagggtgtgttatgaacgaacctccttcagtccaactatccagacgttcattctctctgccatttggcacggggtatacccaggatattatctaacgtttctaacaggggtgttaatgacattagcagcaagagctatgagaaataactttagacattatttcattgaaccttcccaactgaaattattttatgatgttataacatggatagtaactcaagtagcaataagttacacagttgtgccatttgtgcttctttctataaaaccatcactcacgttttacagctcctggtattattgcctgcacattcttggtatcttagtattattgttgttgccagtgaaaaaaactcaaagaagaaagaatacacatgaaaacattcagctctcacaatccaaaaagtttgatgaaggagaaaattctttgggacagaacagtttttctacaacaaacaatgtttgcaatcagaatcaagaaatagcctcgagacattcatcactaaagcagtgatcgggaaggctctgagggctgttttttttttttgatgttaacagaaaccaatcttagcaccttttcaaggggtttgagtttgttggaaaagcagttaactggggggaaatggacagttatagataaggaatttcctgtacaccagattggaaatggagtgaaacaagccctcccatgccatgtctccgtgggccacgccttatgtaagaatatttccatatttcagtgggcactcccaacctcagcacttgtccgtagggtcacacgcgtgccctgttgctgaatgtatgttgcgtatcccaaggcactgaagaggtggaaaaataatcgtgtcaatctggatgatagagagaaattaacttttccaaatgaatgtcttgccttaaaccctctatttcctaaaatattgttcctaaatggtattttcaagtgtaatattgtgagaacgctactgcagtagttgatgttgtgtgctgtaaaggattttaggaggaatttgaaacaggatatttaagagtgtggatatttttaaaatgcaataaacatctcagtatttgaagggttttcttaaagtatgtcaaatgactacaatccatagtgaaactgtaaacagtaatggacgccaaattataggtagctgattttgctggagagtttaattaccttgtgcagtcaaagagcgcttccagaaggaatctcttaaaacataatgagaggtttggtaatgtgatattttaagcttattctttttcttaaaagagagaggtgacgaaggaaggcaggaatgaagaagcactgcgtggcctccggtggaatgcacggggcacagccgcgactctgcaggcagcttcccccccatgccagggctctgcgccgtcatgtgagacttaaaaaaaaagttgaatgacttcgtgatactttggacttctaaattaaatttatcaggcataaattatgtagaattagaggctttgaaaataatactggtaggttgctcaaaggttttgaaagagaaatcgctaggtaggttactatctggctaatccatttcttatccttgacaatttaattcatatttgggaaacttttagggaaatgaaaaataaaagtcactgagtctgggtgacattttttaagaataatataaattcagtttcaaactcttctcacattaaaattttgctgtgaactcttactaaaatgagttttaggttctgtaagtggaaaaatgtgcttttattttatgggccatttttaccacaactaatcttgccttggattactaagcatctcctgcgatcccacagaggactgtggtggccacaggagctgaaagcagaagagtgggatttgatgccaggcagtggagtggcctcagccccagattgtacctcctgccctgtaggaggggagggggcaaagccttctgacttcacctttgtttgacctatgtatggaacttacttttactttttgccttaaatttttaatgaaatgcaaattttctgtgatggggttctctctctctttttttcggggggtggagtcactaataaatttgcaaatgaagttaaagacaaggcaaccatctggcttatgctatataatacttcatttaaagaagaaaggaaaagcaaatgcacttgcagcttttgaggtctcagcaaaaatgggcatgtgtcttttttgaagtttagaaatatcctaatctatttttatttatctaaaagtaagtgttttccggctgataaggctaaccctacccaggaaaggattgataactaaataaatttcctctgttttcccatgcattgaaattatgttggctgagcatggtggctcacacctgtaatcctagcactttgggaggccgaggtgggcggatcacttgaggtcaggagttggagaccagcctggccaacgtggtgaatccccgtctctactgaaaacacaaaaattagacgggcatggtggcgcacacctgtaatcccagctacttgggaggctgaggcaggagaattgcttgaacctgggaggtggaggttgcagtgagctaaaattgtgccactgcactccagcctgggtgacagaggaagactccgtctcac

SEQ ID NO: 53 - DNA, 6222 bp, Artificial Sequence
  Description of Artificial Sequence: Synthetic polynucleotide
atgactgcggcagcgaactgggtggcgaacggggcgagcctggaggattgtcactccaacctcttttcgctggctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagatcctccagaaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaa

SEQ ID NO: 54 - DNA, 1508 bp, Artificial Sequence
  Description of Artificial Sequence: Synthetic polynucleotide
atggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtga

SEQ ID NO: 55 - DNA, 13213 bp, Artificial Sequence
  Description of Artificial Sequence: Synthetic polynucleotide
atgtggctgctggggccgctgtgcctgctgctgagcagcgccgcggagagccagctgctccccgggaacaacttcaccaatgagtgcaacataccaggcaacttcatgtgcagcaatggacggtgcatcccgggcgcctggcagtgtgacgggctgcctgactgcttcgacaagagtgatgagaaggagtgcctctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgaaaagacgacacgaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatattgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagagaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccaccccccatggtggaaggagagggattagccagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaaggagacagagtcagatcaagatgatgagattgagaaaacagatagacgacagagcttcgcatccttagctttacgtaagcgctacagctacttgactgagcctggaatgattgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatcctttcggacaatgtcttcgccgataaaaactgtggtgtcacaatctccatacaatatccaagtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcagcagttgatgtcatttcatcagccaaaattacaatggcatcttctctctcatcacctgtgaagcagatgcctggacatgcagaggtagcattagtcaatggatctatttcccctctaaaatatccatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgaggagagacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaagcactggtcctaaaccactttttcatgaagttcccatccctcctgtcattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgacgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacacagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaa

SEQ ID NO: 56 - DNA, 7506 bp, Artificial Sequence
  Description of Artificial Sequence: Synthetic polynucleotide
atggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggaggaaaaggccaaagttgttgagcccctggactatgagaatgttattgcccaaagaaaaacccagatttacagcgaccccctccgagatctgcttatgttcccaatggaagatatatctatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaagatgatgaaactagcagccaaggaaaagccgagaacatcatggcaagtttggaaaggagcatgcatccggaactgatgaagtatggaagagaaactgaacaactaaacaaactcagtagaggagatggaagacagaatctcttttcttttgattcagaagttcagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaaattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggcaaggaacattgcagtctgtgtggaattccgggattcagatgaaagtgacgctagtgccctaaagtgtatttatggaaaacctgcagggtctgtttttaccacaaatgcttatgctgttgtctcgcatcacaaccaaaatccagagttctatgatgagattaaaattgagcttcccattcacctacatcaaaaacatcatttgcttttcactttttatcatgtaagttgtgaaattaacacaaagggaacaaccaaaaagcaagacacagttgaaactccagttgggtttgcctgggtacctttgctgaaagatggtagaatcatcacatttgagcagcagctgccagtttccgccaatcttcccccaggctacttgaatctgaatgatgcagaatcaagaaggcaatgtaacgtggatattaaatgggtagatggtgcaaagcctttgttgaagattaaaagccacttagaatctaccatttacactcaagatctgcatgtgcacaaattcttccatcattgccagctgattcagtcaggctcgaaagaagttccaggggagctcattaaatatttaaagtgtttgcatgccatggagatccaagtcatgatacagtttctacctgtaattcttatgcaactcttccgagttctcacaaatatgacccatgaagatgacgttcctatcaactgcaccatggttctcttacatattgtatcaaagtgccatgaagaaggcttggatagttatctaagatcattcataaagtatagcttccgacctgaaaaaccgagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtga

SEQ ID NO: 57 - DNA, 1889 bp, Artificial Sequence
  Description of Artificial Sequence: Synthetic polynucleotide
cagaatcggagagccggtggcgtcgcaggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatcaa

SEQ ID NO: 58 - DNA, 808 bp, Artificial Sequence
  Description of Artificial Sequence: Synthetic polynucleotide
atggcggatggccccaggtgtaagcgcagaaagcaggcgaacccgcggcgcaataacgatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaa

SEQ ID NO: 59 - DNA, 1554 bp, Artificial Sequence
  Description of Artificial Sequence: Synthetic polynucleotide
atgtccggagaggatggcccggcggctggcccgggggcggcggcggcggctgcccgggagcggcgacgggagcagctgcggcagtggggggcgcgggcgggcgccgagcctggccccggagagcgccgcgcccgcaccgtccgcttcgagcgcgccgccgagttcctggcggcctgtgcgggcggcgacctggacgaggcgcgtctgatgctgcgcgccgccgaccctggccccggcgccgagctcgaccccgccgcgccgccgcccgcccgcgccgtgctggactccaccaacgccgacggtatcagcgccctgcaccaggcctgcattgatgagaacctggaggtggtgcgcttcttggtggagcagggcgccactgtgaaccaggcagacaacgagggctggacgccactgcacgtggccgcctcctgtggctacctagatatcgccaggtacctcctgagccacggggccaacatcgccgccgtcaacagtgacggggacctgcccctggacctggccgagtcggacgccatggaggggctgctgaaggcggagatcgcccgccgaggtgtggatgtggaagcagccaagcgggcagaagaggaattgctccttcatgacacgaggtgctggctgaatgggggcgccatgccagaggcccggcacccccgcacaggcgcctctgccctgcacgtggctgctgccaagggctacattgaggtgatgaggttgctccttcaggctggctacgacccagagctccgggacggggacggctggactcccctgcacgcagcggcacactggggcgtggaggatgcctgccgcctgctggccgagcatggcgggggcatggactcactgacccatgcggggcagcgtccctgtgacctggccgatgaggaagtactgagcctgttggaggaactggcccggaaacaggaggacgcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaa

SEQ ID NO: 60 - DNA, 6864 bp, Artificial Sequence
  Description of Artificial Sequence: Synthetic polynucleotide
atgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggctataatgaaattcagagtttatatgctggagaaaaatgtggtaatgtctgggaagaaaatagaagtaaaactgaagaccgacatcctgtgtaccatcctgaagaaggtggagatgaaggtggaagtggttatagtcctccaagtaaatgtgaacagactgatttatatcaccttcctgaaaactttaggccatataccaatggtcagaagcaggaatttaataaccaagcaaccaatgtaattaaattttcagatcctcaatggaaccattttcagggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaagaaggatgaaaaaagcattgaggttgagactaaaacagatacctcagaaaaaccaaagaatcaattatggcctgagtcttctacttctgatgttgtcagagatgatattctgctgcttaaaaatgaaattcaagttttacaacaacaaaatcaggaacttaaagaaactgaaggaaaactgagaaatacaaatcaagacttatgtaatcaaatgagacaaatggtacaagattttgaccatgacaaacaagaagctgtggataggtgtgaaaggacttatcagcagcaccatgaagccatgaaaactcaaatacgtgaaagcctattagcaaagcatgctttggagaagcagcagctctttgaggcttatgagagaactcatttgcaactgaggtctgagttggataagttgaataaggaggtgactgctgtgcaggaatgttacctagaagtgtgcagagagaaggataatctagaattgactctcaggaagaccactgaaaaggagcaacagactcaggagaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaa

SEQ ID NO: 61 - DNA, 706 bp, Artificial Sequence
  Description of Artificial Sequence: Synthetic polynucleotide
atggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggagtagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactga

SEQ ID NO: 62 - DNA, 1677 bp, Artificial Sequence
  Description of Artificial Sequence: Synthetic polynucleotide
acaggcgcgcgcgaggacgcgctccggggacgcgcgaggacgccgtggcgggagaagcgtttccggtggcggcggaggctgcactgagcgggacctgcgagcagcgcgggcggcagcccgggggaagcgtatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaatagtagcaaattgtttttgctttgaaaatctagccatcctacatcctttggatttcttcacaaggcagtaattcctttgaactactgcttagctaatactaggtagtgctaaaagacatgttcccataacttttacaacattttactttttatcattgatgtgttcaaactgtttacaaggagatgcttatagatgatagttgtacatatgtgcaaaaaaaaatccacttgcaatggtaagaaattgaagtatccttaaaggccatgaagccatatgtccctaaa

SEQ ID NO: 63 - DNA, 5970 bp, Artificial Sequence
  Description of Artificial Sequence: Synthetic polynucleotide
atgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatacattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagccgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaa

SEQ ID NO: 64 - DNA, 1386 bp, Artificial Sequence
  Description of Artificial Sequence: Synthetic polynucleotide
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacagtccaccaatcgattactttgatgtatttaaagaatcaaaagagcaaaatttctatgggtcacaggaatccatcattgctttatgtactcacctgcaacaattgataagaactattgaagacctagatgaaaatcagctgaaagatgagttttttaaacttctgcagatttcactgtggggaaataagtgtgatctgtctctctcaggtggagaaagtagttctcagaataccaatgtactaaattcattggaagacctaaaacctttcattttattgaatgatatggaacatctttggtcattgcttagcaattgcaagaaaacaagagaaaaagcttctgctactagagtgtatattgttctcgataattctggatttgagcttgttacagatttaatattagccgacttcttgttgtcctctgaactggctactgaggttcatttttatggaaaaacaattccatggtttgtttctgatactactatacatgattttaattggttaattgaacaggtaaaacacagtaatcataagtggatgtccaagtgtggggctgactgggaagagtatattaaaatgggtaaatgggtttaccacaatcatatattttggactctgcctcatgagtactgtgcaatgcctcaggttgcacctgacttatatgctgaactacagaaggcacatttaattttattcaagggtgatttgaattacaggaagttgacaggtgacagaaaatgggagttttctgttccatttcatcaggctctgaatggcttccatcctgcaccactctgtaccataagaacattaaaagctgaaattcaggttggtctgcagcctgggcaaggggaacagctcctggcctctgagcccagctggtggaccactggaaaatatggaatatttcagtacgatggtcccctttga

SEQ ID NO: 65 - DNA, 2084 bp, Artificial Sequence
  Description of Artificial Sequence: Synthetic polynucleotide
atgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataa

SEQ ID NO: 66 - DNA, 1629 bp, Artificial Sequence
  Description of Artificial Sequence: Synthetic polynucleotide
atgggcaagaagggcaagaaggagaagaagggccgcggcgcggagaagacggccgccaagatggagaagaaggtgtctaagcgctcgcggaaggaggaggaagacctggaagcgctcatagcccatttccagacactcgatgccaagaggactcagactgtggaacttccgtgccccccaccctcaccaaggttaaatgcctccctctcggttcatcctgagaaagatgagttaatcctttttggaggtgaatatttcaacggccaaaaaacttttttgtataacgagctctatgtctacaataccagaaaggacacctggaccaaagttgacatccccagtccacctccgaggcgctgtgctcaccaggcggtggtagtgcctcaaggtggcggacagctgtgggtctttggaggggagtttgcctctcccaacggagagcagttctaccactacaaggatctctgggtcctgcatttggccaccaagacctgggaacaagtcaaatcaacaggcggtccttcgggtcggagtggacatcggatggtggcctggaagagacaattgatcctgtttggtggcttccatgaaagtacacgggattacatctactacaacgacgtgtatgcctttaatctggacaccttcacatggagcaagctgtccccgtcagggacggggcccacacccagatcaggctgccagatgtccgtcactccccagggcggcatcgtcgtctatgggggctactcgaaacagctgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctga

SEQ ID NO: 67 - DNA, 4059 bp, Artificial Sequence
  Description of Artificial Sequence: Synthetic polynucleotide
acctgagactacctttctgcgatcacaggattcccggcggtgacttgaccccggaagtggggtgtgaagctccggtgctggtgcggcgggggactgcggggccagcctcaggtagcagcagcagcagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccaccaccaccaataatacttatcagcatcataaagtatctcttaaacactgatcttggcagggacggaactcctattcagcagtttttgtggaaagcagtaatgcttgcaaaacgtgtgtgtcattcagcattttaagtggagactatgcatttcatagtatatttgacagattagtactgtgtcctgtgttttgttccagattcttcagtataaataagctctatatcaaaaagttgcctgtctaaatagaaaatgtcttgctgtgttttgtcctatggaaaatactgtaattcaggattatgtttacaattgatccaggtgtttgtttctaacttctgtaatacatacaatgcaaaaaaaaaaaaaaaaaaatggccacaacagttgcacagtgcccaccctatggcctagcttcaggtacttcagttgaagtctaaactcaggtaacttggaatgtatatcatattgggatattaaatatttcacagctaaaaagctaaagagggaacatcactcttttgcctttccttattttatgcatttccctttcctcattacattccacattcttagaataagaagtgcattcaatcctaggagaatgataatcctggacatgggtgaacatgaggagaaccagcaaaatctgtggtgtttgacatcactttgtcatgtggttacaagtaaaacaactgttgcattcactgtttcaacatgtgtacatgtggcttttttaaaagttcaggtgttgctcagtaaaggactgtgacaatgttgcaaataaagtgttcagtactggactgtacataaacattccacattgtgtgtgatgaaatttaaagacaagaatgtctagagttaatttcaaaataagtgaagtgtttgacggaatggttgagatttttttgtttatgttagccatcagggtcataactgttaccattttatctaaagacatatttatatttagtttctcccttggaaattctttattttgcaggtgaaaaagtgacatactttttgttattgtcttcctcaagcagtttaggtgcatgatcttcatttacatagaatacttgggtctcagaattgatgcaacataagcaggtttttttggtgacttacaagagcaatagtttgaagctatctcatttaagcctctcataatgcataatcatgagtagttttgaaatttgcaacctgtgaggtagagcataaactcaagaaaatagccttgaacttgcagacttttgacacaagttctccacaaagtgtgaagagagccccaggcattcctgattggtcaatgggagagcctaactttcattgttttcttcagtacaaagagtatccaaaagctaagtttttgtattccactactttcagttcaataaaacctagagttgtttcatctgcgcctaaagtgtatggcacaattttcttaagaattaggggaaccaggtgcctacagttaaaggaacgtttcagttcctttcattcattcctgggtttttcttttattttctaagaaggttgaagaaggatgagtgatagagaagaaagcaacaccattgatttttttttttaagaaatgatatatatatgtatatgtttgtgtgtgtgtgtgtgtgtgtgtgtgtgtgtattctgtgcattattttgtcatgatctcaattctcttctttccaccaaagtttgtcgtaatattttctcctgaaggtgcattctggctcctttaaattagtcagtgttatattgtaggagactgtcatggaaaaaaggactcagtttactttcgtcattttcacaggggaaccttttaaaacaatcttttcagcagcagatacctttaaccctaataatctcaggccttgatgaaaatactatattttgtagattatggttaaagggggaaaattactagttccgtaagataaatatgagctccatttgacttctgatgtctggtttagcattacataatatgttgatcttacactctgcttttgtccaaataaaatgcaatagtatcaatatcaatttcagaaaaatggactgaatatgcttttttggtgatgaaatctcatgtacgatatttatagtgatgtgcttttattttctcatgagatactaaatattaattgtgttgtacatttgttcttagcatatattaaagttttgaaccaaatgtgttaaagcttacgctttgccatgtaaatttcccagaagttgttgagctcaaatgtatcctacatccagctgtagaaatttgtcagaaattgtttaaattttgtatataattgtactgtttaattctagccattgcgctgaacagtatttgagttaccatataatatggctttacacaaggaaatgtgtggcttttgttttgtattttttcagtatagaagttcctgtgtcttatttaaataaagttattagtaaaactgaaa

SEQ ID NO: 68 - DNA, 686 bp, Artificial Sequence
  Description of Artificial Sequence: Synthetic polynucleotide
atggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtga

SEQ ID NO: 69 - DNA, 3693 bp, Artificial Sequence
  Description of Artificial Sequence: Synthetic polynucleotide
acttcctcatagaccttggatgtgggaggattgcattcagtctagttcctggttgccggctgaaataacctgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccatat

SEQ ID NO: 70 - DNA, 11996 bp, Artificial Sequence
  Description of Artificial Sequence: Synthetic polynucleotide
cggggactggcctggcgccggcggcggcggagggggcgccgcgggcgggcgatgtgagcgcggcgctctggacaggactgaatttgctcttaaagaaatcatgtcctctggaggtgctgaagatgatatcccacagggagagaggaaaacagttacagatttttgttatcttctggataaatctaagcaactgttcaatgggttaagagatttgccacaatatggacagaagcagtggcagtcctattttggaagaacttttgatgtttacaccaaactctggaagttccagcagcagcatcgacaagtcttggataatcggtatggcttgaagcgctggcaaataggagaaattgcttccaagattgggcagctatactatcattattacttacgcacatcggaaaccagctatctgaatgaggctttttccttctattctgcaatcagacagagatcatattattctcaagtcaataaagaggacagacctgaattggtagttaagaagttacgatattatgcaagatttatagtagtttgtcttcttctcaacaaaatggatgttgtaaaggatctggtaaaggaattgtcagatgaaattgaagattatactcaccgatttaatactgaagatcaagtggaatggaacttggtgcttcaagaagtagcagctttcattgaggcggatcctgtaatggtattaaatgatgataataccattgttatcacatcgaatcgccttgctgaaacaggagccccattgctggaacagggcatgattgtgggacagttgtctctggctgacgcactcattattggtaattgtaataatcaggttaagttcagtgaactaactgttgacatgttccggatgttacaagctctggaaagggagccaatgaatttagcttcccagatgaataaaccaggaatgcaggaatcagctgacaagcctactagacgagaaaacccccacaagtatctgctctacaaaccaaccttcagccagctatataccttcttagcagcgtcttttaaggagctgcctgccaatagcgtgcttctgatttacctgtcggccactggcgttttccccacaggtcgttctgatagtgaaggtccttatgattttggaggtgtacttactaatagtaaccgggatattattaatggagatgccatccacaaacgaaatcagtcccacaaggaaatgcactgccttcatcccggggatctctatcctttcaccaggaagccactgttcatcattgtggattcgtctaatagtgttgcgtataagaatttcacaaacttgtttggacagccactagtctgcttgctttctcctacagcatatccaaaagctttacaagatcaatctcagcgaggtagcctcttcactctctttttgaacaatcctctaatggccttcctatttgtctctggattgtcaagcatgcgcagaggcctatgggaaaagtgtcaagaatatcttcgaaaaatcaaccgtgatattgcccagctactgactcattcacgttcaatagatcaggcatttctccagttttttggagatgaatttcttcgcttgctcctcacaagatttatcttttgttcagccaccatgaggatgcacaagatttttcgggaaacacgaaattatccagaatcatatccacaactgccaagggatgaaacagtggagaatcctcatctccagaagcacattttggaattagcatccattctggatgttcgaaacgtgttctttgagaataccattgatgactattaaaacaaaaaccctgttgtcgaaacaagttttcattttccacaaattttaaatggtgcagttttctaacgtgataagacacatagtggtgttacttagtttttattttttaatttagggccaccattttaaaaacaaacaaaaaaatgttcacacttttagggtaactgttttaaaatgcaacctttcaggtcttttaaaatcttaaccttggaatttttattttttgattttgagggatggatatttacctccaacttctaatcctacactcaaatagtcactattctcaccctgagaagagtaaatcatttatttttgtataatgaggtaaatccaactcttatacttggacctaagttaaatgtctggatttggaaatatgtaatggttcataatgatgaagctagccaccatggactactgaaaatcaagaacagagtccctccataatatattttttctcattccaacttagctggtagaaaaatgtttgatcctttgaaacatgatcaagccagttttttgaaatcatttaatttctttcaatactgtcataatttcagaaattggattgaattgcatctgaaagctacatcttgattgaggacttgaggtggtaatattacttggaatgtatgagtattatgagatttatttgcatattttctttgtagtctgtgaatgctggaaatgaaaaaggaaacaactttgaaatattttagtcaaaaaaccatgtcattggtttcataatacaatgtctccaataggaattctatttaaactcttggtttatgagatcacatttaaagactggattgatgtctgtgacataaagttttaattttttgcctcattcaaatttatgagacttcaaagtcatagatgttttaaattttggtaaggggtaactgggtgttatgaaacctaaaatgtaagttgattttgcattggtaatttggaaataagatttattaacattccctgtatttagtattttatattcatgcacaaaatttttattatcttaaataggactcagtgtatattataaagatttttcttttttgtgttttccttccctgtcattccctttataatttcacagtcacttgctatgaagtcctccctcctttttgattatgcagcattcaatttcagaaatctatgaatgagaaggccttatacctaattttctgtacaggatcacatctggcagtcccaggagaagtgagctgattgcttttgatatctctttcccatggccctaggtaaattatactctaaatttatttattttttttgaaacagagtcttgcttttgttgcccaggttggagtgcagtggggctatctcggctcactgcaacctccgcctcccaggttcaagcaattttcctgcctcagcctcccgagtagctgggattacaggtgcccgccaccatgcctggctaatttttgtatttttagtagagacggggtttcaccatgttggtcaggctggtctcaaactcctgaccttgtgatctgcctgcctcagcctcccaaagtgctgggattacaggcgtgagccaccgcacctggctattatttttaacttggttttcatttctggcatagagactaatttgggtctaagttattcccattcctgctttgatttgctgatttttcaaacctgaagtccaaagttactgtttttggggtttggggacttggggagtattttacttttttttttttttttttttaagagacagagtcttgctttgttgcccaggttggggtgcagcggtacattcatggctcactgcagcctcaaattcctggattcaggcaatcttctcacctcagcctcccaagtagctgggactacaggcatgcgccaccatgcctggctaattttctttattttttaattttttgtagagacatggtctcactttgttgagcaggctggcctcaaactcctgggctcaagtgatcctcctgcctcaacctcccaaagtgctaggattacaggtgtgagccactgtacctggcctgtttactttttaaaaatttttttgtttgttctttcaaacagtatttcagaaagcttgggaaaagttaccctggaaagatttcctttgctagtgggttttcattttcaggtaaagactgctttccttttttttcagtatcttaataaacttcatagctttcctttagtaacagtgttcattgaactacagcaatagactatcttcggttttctgacctcttgtttcaattccccttaagtcctgtgccagttatgctcctaccaacacagagtttcctgtcctctaatgtttaaaatagtatttactgttctgagctttatcctcccccgttaagcataaagaacactggtctgagaactaggagacctaagttctagtcctggctttcctggtaacttaagcgttatgccctttgacaactgtcttcatgtctctgcttgttagcactctcatctgtaaaatgaagaggttggcccaggtcttctccaactctgattctgtaatttggactcttggttccaaaaatattgatttccccactccaaccaccaagagaactatttaccctgtttgtagtgtacacaaccttttcttttgtaagtcatatttacctagattttgttcaagaaaatctgggtcccacttagctgttttagaaactagtacagacagagactctcctgaggaaattagagcttttatgattagaaacatgcttgtctaaaaatgagggtcttagaaatcacaacattgacccttatgatgttgccccttaagctaatagtgtaattccttactggtagttaaaaatctaaagtggactgaagtgatcttgaatcttcaaagagaggaaaactgtgctggaaaatgttattgtttcattgatgccttcaaaaaaatgcgtattaaacaaagactatactccagattttcttctgggcattggggaagcaaacaaaatagacttaaaaatcctcatgttcatgaagcttacattctagtagaaggagtaaggcaataaacataagtaatttatgttagaaaatgttaagtaggatggaaaagtgtagattatggtaaggtaaatcttttgtttgttttcttaagagaagaacaatgtttaaaagagtgatcaagcagggcatggtggcatgaccctattagtcccagctacctgggaggccgaggtgggagggtcacttgagcccaggagtttgtggctgcagtgagctgtgattgcaccactgcactccagcctggatggcaaagcaagacctcgtctctggaaaaaaagaaaagaaaaagtgatgatcagggtaggcttcattaggaaggtcacatttgcatgaacactttgccttttctttctttttatgaaagttttaaacatagtttttttgttttttgtttttgagacggagtttcactcttgttactcaggctgcagtgtggtggcaggatctcagctcactgcaacctccaccttccagtttcaagtgattctcctgcctcagcctccccagtagctgggattacaggcatgtgccaccacacccagctaattttgtgttttgagatggggtttcaccatgttggtcaggctggtctcgaactcctgatttgaggtgatccgttggcctcggcctcccaaagtgctgggattacaggcatgagccaccacgcccagcctaaacatacagtttaataaatcctccttgtaccttacccagcttctgtatttctttaatcaagggagaagaattatctaaaaggacagttgcccaatgggcttgagctgatgatagtggcaaagaatttcattttttaaaaatgcataccacctgccctttataaaaaaatttaaaccctaatgtatttaattttataattcataaaaatttaaatattggaactaagaacagagcaaagcaaagggaaaaagcactcctttgttttcaaattgcacaaactgtccctggagattctgatagtctctcatctctcttaactatcactgtaaacaacatagaaagcataagactgcaagaagtcagttatacacaaaacaaaatgaagcacagtggaattttctctttctttatctgtatatttctgaagttggtaaagcaactatcttctctattttacagaagagaaagctgagacccaaaaagctattcatagtgatagagctagaactaaaactcagatctcctcatctcagcccagtcttctcagtagctcagactgctttctataatgaacaagaaagaataattagggatttgtattttggcacaaaacagtatcaaatttttattgtaaaaatccacaaatctgacattttatcttttattctagccaggatgtattcttcatttgcatgtgtgtgtttctcttagaaagtggtgctctcaaacctttcaaagcacagaatttattgtaccctctttatttttaccaaattgaaacgtttcaggatttcagaagcaaagtgcaatccaattgtggctggagttttcctgatagaggatccgggtggttccctcccctccaacttctggctactgccctttatttcctttgtgcaatagaattccctgaaacagattatgtcgtaattatactgatttagtcaggataatgggaaaagcgacaaatcggatttatgtattaggtattatggagctttctttagcactctcctccaagtttaatctctgacatgtgtgatatagtaactttctgtctctgagaagcagtttggacccagctgaaaaattttatttatggagacttgtaatcagcctgatatacagagaacactctggactggaaatatagtcaggtaccaaggtctgctaatttggccattgccagtgattcaaaaccacctccccaccctgagtaaaagatttgatatgaatatgaatgctatgagtctcctggtgatgttttgggtgtatatgttcctgtgtgtgtttggaaatcatagagggtatttaccttgagggctcttttgttgaccttatttatttgaaattcttattttatttgtaatggcatatgtatatttttgtgatgctacatgcaatctctgtgtatactttttgtatatatgtatacatatttgtaaatatattggtatgcagtgatacagtatgtgtatattatgtacccatacccattgtgggctgaatttatttaagttctgtgaggacatcctagtggcattgttcatgctgctgtaattaggttgtggctgtatctcattcataagcctctattttgagaggcttgtgtttggataaaatgggctaatttggagttgaaattaggatatgaagatcttaacagaaagctagatatttattcttagctttaaaatcacctgcaaatttttatttaaactgatgataaattagtgatataacctgaaaaacctaagtatgtgaaactgagacaccagcagattcttaggctgtagtagtcctttattttcttgatccatatttaagtattattactgagtagtaaattatgtatattggggcttaatagagaggctgtggaaaaaaattgctttaatcacatttaaaaacataggaaaatgtccattaaataggggaaatatattcccagttgtcatttttatgcctcatactgaattttgattttggaacaattcttttttcatcagtgttttatgtgtctctatgaggcagaaaagggggcattagctaagggatggcctaacctaagtaggataggatttagtgaggaacgggaggttgttaatttgtatatttgcagcagctatgattaatttagtcctgtcttggcatttccggctacagattttttcttactggacttgcatatcaaaggtgagtaggctcatctgagaaaatgcttccactgaataaaatgccttcactcgtattgctgtgtctctatgagaccacttgtgttctgcaagttgatgatatattcgcacatgaagtagagtttttaatattagatgcatggtgtgctataaaaatctgggccttcaaacctctcccaaggatgatagggttggggaggataagaggatagtaaatacgtgcaatgccaatttgtgaacctatagaatgttgccaagtatcaatgtttggttacttcagttgacatatttatttgcatgaaagagtgtaggagatgtttaatatacacttaaatacattcactgcagaaattaagtagaggttatttttgcatgataaaatataactgcaaagcaactttttacaccgtattctttggaagattaaatctatctgatccaatattatcttaaaatagagaaattatctcaggagtctgttttaccacccaaaaaaatgttacatttgctgattcattatattttaaataaaacagccaactattcataagacttttcaattatagtattaaattcagaaataattataacagcatttttcttgaataaatattaaaatttggtaatttattatttctgaaaaatcagtgaaaacatccataggatctgatggtttgttgtttgaataaccaaatcattgtttttgcactggagagtagtagagcagatattataccatttaaaattcatggaactgactcaggctccttgtggatattaatttgaggacagtagtggtaatcaaaagtacagtagaaaacacttgacattgtgaatgtgacctctgaccccaaccgttgtaaagccaataactttgagggtgaataaggtaacacttgcttagaaaacccagccctttcccccagtctcctgcgctcttatacattgatactttacaactatttttgctgtacctctcagtctttcctggataatgggaccacttaaaaaaaaaagtgattcatcttcctcaaactagaatttcaaagcctaatactacactatgttccagcttcactgagttttgaacaaaaagacttaagcatgccttgtgtttaaggaaaaataattgatgtgtgaatggaatcaatcacctattgacgggaagggtgtcaggatgatgtagggtgatatgcctttaattggataaagagaactgtattaagtataactaatttaataactgattgaagcaccattcttaattttaaaatatttttgttaatttcttttgtggttttaaaaattaataatttttttttttttgagatggagttttgctcgttgcccaggctggaatgcaatggcgcgatctcagctcactgcaacctccgcctcctgggttcaagagattctcctgcctcagcctcccaagtagctgggattacaggcgtgtgccaccacgaccagctaattttgtatttttagtagagatggggtttcaccatgttggccaggttggtctcgaactcctgacctcaagtgatccacccgcctcggcctcccaaagtgctgggattacaggtgtgagccactgtggccggcctaaaaaaaattctttttaatagttatcagactactttaaccagtgccatgtttaaacatacttggacaatagactcagtttttttaatagtttgaagtacattatattaaaactacaaactcacttattcaagcctaaatttcatcatagactataaattgggtatcaatttcctattttggtggacaattccagtctgtctactacgacaatcatctttttaggtgtaatattgtttaagacataggtaattttaggttttatacttttctcctaggcttatggaatgaaagctaataggatatcactttcagaatgaaatagggaattatggctagccttcttatagggctgccgtaaatgatacttaaatgtttgttatatcactgattttcttttctcttctgaagctgttgtgaatgtccactttgccatgattaaaagttgagatttgtaaacattacaatttgaaccataaattttctcaaacatgaaatcagtatgaataagtataaaatttgaaatgatcatacatgagaatcccaaaagtaaatacttccaaaccatagagggataaccactgtatttttaaaaagcttatttccacccttaaagaagcatgctactaattgctttttttctaaattaaaactatgtactgtggtaaattaaaaatctgcaggaaaaattgcttagtgttttagcacaataagaatttttattactcaggagttggagaccagtctgggcaatacagtgaaaccctgtcgctactaaaatacaaaaaaaaaaaaaaaaaaaaaaaaattagccaggcatggtggtgtgcgcctgtaatcccagctacttgggaggctgaggcaggagaactgcttgtaacctgggaggcggaggttgcagtgagccgagatcgtgccattgcactccagtctgggtgacagagcaagactcattctcaaaaaaaaaaaaaaaaggaatttttattactatttcctgaagaatggtttttgttaacttgttactgtatcattaaaaagaccttctaatggttcagtacaataatctagaacttgatttatgtggctttttatagttatctgaatgcattccttttgccacatagaccatatggctagttctccaacttttttgcttatttttaataaaccttgctgttcaacaatcagagaaacctttagattttggatgattcttccagttgaggtagaaacatcttagataataggaaaggcaaatacaaagtcctaacattttcatagtagagtttacaagtaaaataacttatccatataggttatcttcgttgtgtagcaccagtataaatagtgatttcattaatcattgaatcagatgaagcagttataaatcactttttactttgtgctaagaattattgtaatttcaggacactttattatttcctctgagcagtttccattggaaggttgagtttcccttttttaagttctaatcatcactaaaggttaagataatcaaataggagttaaaataagttatgtttgatctttttcccttgaaaataatgctgaacttattgtctacattctgattattaggcagaaatgcacttgtttaaatcatagaagtaattcatttggaggatataattactcgattttctagtggtgtgaaatactttttaacaattgtgcttgtctgtaactgaaatgttatagaattttaacactatagggattatagagttatattagctctcctcaagagactgaagcacaatatttttcatgtaacaattcttatccaagtgctgctaatctgtcgtgcaaataatgaagctatttggttgcctatttagctattcacaaatcactgtaatctttgaaacaatcttgtcgttcatttgtattaatatttggatattgtgagttaatactttagaaaaaaatccatcaactcagccccgttagcaaaactgtttggattcatagtttttatatgtgttaacagtagaataaattttgaaggggctatttactaccaatgactaaggggaaaattatactgtcactatcatttgacttgaacatttgtggtattgtaaaagtcttgtcagttgtgttctaaattgcttaagccatacgttctcttaaacaggatgtttttttcttcctttccagcagcctttttcttctttgtctgttatggttaatactccatagattttagaaattgagaagttcttgaaacattttattttcttgagttcatcacttttgactcttgtatgagatgtgatttgtcataaaagatagccttccactacttcactaaatgaatttcagagtaaacactgtgattctgcagagcggattcagtaggctttccaatgttttctcctgctatacagtgcctaccaccttgagggcacttcagtactagaggatgaaaactgaaacgttgttttgatgtttattgaataacgagattagagaatatttgatttttgttgtcagtgtattaaagaaattttcacattgataaatgttctctaggaatgtgtctacattcatcaggtgtgaactcttgtacatgaattttgtaccttgaatccacatatatattaagtgtatcatcaatataaaaataaacattatttgcttaa

SEQ ID NO: 71 - DNA, 6714 bp, Artificial Sequence
  Description of Artificial Sequence: Synthetic polynucleotide
atgaccgctgagcccatgagtgaaagcaagttgaatacattggtgcagaagcttcatgacttccttgcacactcatcagaagaatctgaagaaacaagttctcctccacgacttgcaatgaatcaaaacacagataaaatcagtggttctggaagtaactctgatatgatggaaaacagcaaggaagagggaactagctcttcagaaaaatccaagtcttcaggatcgtcacgatcaaagaggaaaccttcaattgtaacaaagtatgtagaatcagatgatgaaaaacctttggatgatgaaactgtaaatgaagatgcgtctaatgaaaattcagaaaatgatattactatgcagagcttgccaaaaggtacagtgattgtacagccagagccagtgctgaatgaagacaaagatgattttaaagggcctgaatttagaagcagaagtaaaatgaaaactgaaaatctcaaaaaacgcggagaagatgggcttcatgggattgtgagctgcactgcttgtggacaacaggtcaatcattttcaaaaagattccatttatagacacccttcattgcaagttcttatttgtaagaattgctttaagtattacatgagtgatgatattagccgtgactcagatggaatggatgaacaatgtaggtggtgtgcggaaggtggaaacttgatttgttgtgacttttgccataatgctttctgcaagaaatgcattctacgcaaccttggtcgaaaggagttgtccacaataatggatgaaaacaaccaatggtattgctacatttgtcacccagagcctttgttggacttggtcactgcatgtaacagcgtatttgagaatttagaacagttgttgcagcaaaataagaagaagataaaagttgacagtgaaaagagtaataaagtatatgaacatacatccagattttctccaaagaagactagttcaaattgtaatggagaagaaaagaaattagatgattcctgttctggctctgtaacctactcttattccgcactaattgtgcccaaagagatgattaagaaggcaaaaaaactgattgagaccacagccaacatgaactccagttatgttaaatttttaaagcaggcaacagataattcagaaatcagttctgctacaaaattacgtcagcttaaggcttttaagtctgtgttggctgatattaagaaggctcatcttgcattggaagaagacttaaattccgagtttcgagcgatggatgctgtaaacaaagagaaaaataccaaagagcataaagtcatagatgctaagtttgaaacaaaagcacgaaaaggagaaaaaccttgtgctttggaaaagaaggatatttcaaagtcagaagctaaactttcaagaaaacaggtagatagtgagcacatgcatcagaatgttccaacagaggaacaaagaacaaataaaagtaccggtggtgaacataagaaatctgatagaaaagaagaacctcaatatgaacctgccaacacttctgaagatttagacatggatattgtgtctgttccttcctcagttccagaagacatttttgagaatcttgagactgctatggaagttcagagttcagttgatcatcaaggggatggcagcagtggaactgaacaagaagtggagagttcatctgtaaaattaaatatttcttcaaaagacaacagaggaggtattaaatcaaaaactacagctaaagtaacaaaagaattatatgttaaactcactcctgtttccctttctaattccccaattaaaggtgctgattgtcaggaagttccacaagataaagatggctataaaagttgtggtctgaaccccaagttagagaaatgtggacttggacaggaaaacagtgataatgagcatttggttgaaaatgaagtttcattacttttagaggaatctgatcttcgaagatccccacgtgtaaagactacacccttgaggcgaccgacagaaactaaccctgtaacatctaattcagatgaagaatgtaatgaaacagttaaggagaaacaaaaactatcagttccagtgagaaaaaaggataagcgtaattcttctgacagtgctatagataatcctaagcctaataaattgccaaaatctaagcaatcagagactgtggatcaaaattcagattctgatgaaatgctagcaatcctcaaagaggtgagcaggatgagtcacagttcttcttcagatactgatattaatgaaattcatacaaaccataagactttgtatgatttaaagactcaggcggggaaagatgataaaggaaaaaggaaacgaaaaagttctacatctggctcagattttgatactaaaaagggcaaatcagctaagagctctataatttctaaaaagaaacgacaaacccagtctgagtcttctaattatgactcagaattagaaaaagagataaagagcatgagtaaaattggtgctgccagaaccaccaaaaaaagaattccaaatacaaaagattttgactcttctgaagatgagaaacacagcaaaaaaggaatggataatcaagggcacaaaaatttgaagacctcacaagaaggatcatctgatgatgctgaaagaaaacaagagagagagactttctcttcagcagaaggcacagttgataaagacacgaccatcatggaattaagagatcgacttcctaagaagcagcaagcaagtgcttccactgatggtgtcgataagctttctgggaaagagcagagttttacttctttggaagttagaaaagttgctgaaactaaagaaaagagcaagcatctcaaaaccaaaacatgtaaaaaagtacaggatggcttatctgatattgcagagaaattcctaaagaaagaccagagcgatgaaacttctgaagatgataaaaagcagagcaaaaagggaactgaagaaaaaaagaaaccttcagactttaagaaaaaagtaattaaaatggaacaacagtatgaatcttcatctgatggcactgaaaagttacctgagcgagaagaaatttgtcattttcctaagggcataaaacaaattaagaatggaacaactgatggagaaaagaaaagtaaaaaaataagagataaaacttctaaaaagaaggatgaattatctgattatgctgagaagtcaacagggaaaggagatagttgtgactcttcagaggataaaaagagtaagaatggagcatatggtagagagaagaaaaggtgcaagttgcttggaaagagttcaaggaagagacaagattgttcatcatctgatactgagaaatattccatgaaagaagatggttgtaactcttctgataagagactgaaaagaatagaattgagggaaagaagaaatttaagttcaaagagaaatactaaggaaatacaaagtggctcatcatcatctgatgctgaggaaagttctgaagataataaaaagaagaagcaaagaacttcatctaaaaagaaggcagtcattgtcaaggagaaaaagagaaactccctaagaacaagcactaaaaggaagcaagctgacattacatcctcatcttcttctgatatagaagatgatgatcagaattctataggtgagggaagcagcgatgaacagaaaattaagcctgtgactgaaaatttagtgctgtcttcacatactggattttgccaatcttcaggagatgaagccttatctaaatcagtgcctgtcacagtggatgatgatgatgacgacaatgatcctgagaatagaattgccaagaagatgcttttagaagaaattaaagccaatctttcctctgatgaggatggatcttcagatgatgagccagaagaagggaaaaaaagaactggaaaacaaaatgaagaaaacccaggagatgaggaagcaaaaaatcaagtcaattctgaatcagattcagattctgaagaatctaagaagccaagatacagacataggcttttgcggcacaaattgactgtgagtgacggagaatctggagaagaaaaaaagacaaagcctaaagagcataaagaagtcaaaggcagaaacagaagaaaggtgagcagtgaagattcagaagattctgattttcaggaatcaggagttagtgaagaagttagtgaatccgaagatgaacagcggcccagaacaaggtctgcaaagaaagcagagttggaagaaaatcagcggagctataaacagaaaaagaaaaggcgacgtattaaggttcaagaagattcatccagtgaaaacaagagtaattctgaggaagaagaggaggaaaaagaagaggaggaggaagaggaggaggaggaggaagaggaggaggaagatgaaaatgatgattccaagtctcctggaaaaggcagaaagaaaattcggaagattcttaaagatgataaactgagaacagaaacacaaaatgctcttaaggaagaggaagagagacgaaaacgtattgctgagagggagcgtgagcgagaaaaattgagagaggtaaatggtcttaaaatggttgatgagccaatggaagagggagaagcagattcttgtcatgatgaaggagttgttaaagaaatccctattactcatcatgttaaggaaggctatgagaaagcagatcctgcacagtttgagttgctcaaggttcttggtcaggggtcatttggaaaggtttttcttgttagaaagaagaccggtcctgatgctgggcagctctatgcaatgaaggtgttaaaaaaagcctctttaaaagttcgagacagagttcggacaaagatggagagggatatactggtggaagtaaatcatccatttattgtcaaattgcactatgcctttcagactgaagggaaactgtacttaatactggattttctcaggggaggagatgttttcacaagattatccaaagaggttctgtttacagaggaagatgtgaaattctacctcgcagaactggcccttgctttggatcatctgcaccaattaggaattgtttatagagacctgaagccagaaaacattttgcttgatgaaataggacatatcaaattaacagattttggactcagcaaggagtcagtagatcaagaaaagaaggcttactcattttgtggtacagtagagtatatggctcctgaagtagtaaataggagaggccattcccagagtgctgattggtggtcatatggtgttcttatgtttgaaatgcttactggtactctgccatttcaaggtaaagacagaaatgagaccatgaatatgatattaaaagcaaaacttggaatgcctcaatttcttagtgctgaagcacaaagtcttctaaggatgttattcaaaaggaatccagcaaatagattgggatcagaaggagttgaagaaatcaaaagacatctgttttttgcaaatattgactgggataaattatataaaagagaagttcaacctcctttcaaacctgcttctggaaaaccagatgatactttttgttttgatcctgaatttactgcaaaaacacctaaagattctcccggtttgccagccagtgcaaatgctcatcagctcttcaaaggattcagctttgttgcaacttctattgcagaagaatataaaatcactcctatcacaagtgcaaatgtattaccaattgttcagataaatggaaatgctgcacaatttggtgaagtatatgaattgaaggaggatattggtgttggctcctactctgtttgcaagcgatgcatacatgcaactaccaacatggaatttgcagtgaagatcattgacaaaagtaagcgagacccttcagaagagattgaaatattgatgcgctatggacaacatcccaacattattactttgaaggatgtctttgatgatggtagatatgtttaccttgttacggatttaatgaaaggaggagagttacttgaccgtattctcaaacaaaaatgtttctcggaacgggaggctagtgatatactatatgtaataagtaagacagttgactatcttcattgtcaaggagttgttcatcgtgatcttaaacctagtaatattttatacatggatgaatcagccagtgcagattcaatcaggatatgtgattttgggtttgcaaaacaacttcgaggagaaaatggacttctcttaactccatgctacactgcaaactttgttgcacctgaggttcttatgcaacagggatatgatgctgcttgtgatatctggagtttaggagtccttttttacacaatgttggctggctacactccatttgctaatggccccaatgatactcctgaagagatactgctgcgtataggcaatggaaaattctctttgagtggtggaaactgggacaatatttcagacggagcaaaggatttgctttcccatatgcttcatatggacccacatcagcggtatactgctgaacaaatattaaagcactcatggataactcacagagaccagttgccaaatgatcagccaaagagaaatgatgtgtcacatgttgttaagggagcaatggttgcaacatactctgccctgactcacaagacctttcaaccagtcctagagcctgtagctgcttcaagcttagcccagcgacggagcatgaaaaagcgaacatcaactggcctgtaa

SEQ ID NO: 72 - DNA, 3911 bp, Artificial Sequence
  Description of Artificial Sequence: Synthetic polynucleotide
tgcgatcacgtgagcacagcagggagggggaggggccctgatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgatcagatgcctttagtcaggtaagtttaagggaaaatacgcagtttaatgttttggtacatataattatgtctgccaaagaaacctttgattgtatcatattgcctatttagtagtgcatagggttcagagtacatgataaaggatcaaaagctttgcattgataagtgtctcataatatttgctgtgattggagaaaaaatgtagtcgtagccaataaattttatcagcttttaagtttcagtattattaaaccattttcatataaactgg

SEQ ID NO: 73 - DNA, 3678 bp, Artificial Sequence
  Description of Artificial Sequence: Synthetic polynucleotide
atgttcaggggtccgaagccccccattgcccccaagcccaggctgactgccccaaacgagtggagagccagtgtgtacctgaatgacagcttgaacaaatgcagcaacgggcggctgccctgtgtagacagggggcttgatgaggggccccggtccatcccaaagtgctctgagtcggagaccgacgaggattacatcgtggtccccagggttccgctgagggaggatgaacccaaggacgagggcagtgtggggaacaaagccctggtgtctcccgagtcctctgcggaagaggaagaggagcgtgaagagggaggcgaggcatgtggcctggagggtacaggagctggtgaggattcagtggcccctgctgctccgggtgcaggagcgctgagcagggagggtgaggaaggcacagaccttgctcttgaggatgaaggggagggctgcgctgatgagccagggacactggagcaggtgtccagaagtgaggaggaagagaagctagtgcagccacacagggagtgcagcctggaggacagtgggccttgggctggagagggggtcttccagagcgacctcctcctgcctcacatccatggagaggaccaggagccccccgacacccccggggaggcagaggaggatgatgaggaaggctgtgccagcacagacccagcaggggcagatgagggttcgggtcctgacaggcccacggaggacatgggacaggatgctgaggacaccagtgaggagccccctgagaaggaggagctggccggggtccaggaggcagagacagccacagactgccctgaagttcttgaggagggatgtgaagaggccacgggtgtcacaggtggggaacaggttgacctcagtgaaccacctgaccacgagaagaaaaccaaccaagaagtggcagccgccaccctggaggaccatgcacaggatgagtccgccgaggagagctgccagattgtcccttttgagaatgactgcatggaggacttcgtgacttccctcacaggaagcccctatgagttcttcccaactgagagcacctctttttgcagcgagagctgttctcctctttctgaatcagcgaaaggtttagaatcagagcaggcaccaaagctggggctgcgtgcggaggagaaccccatggtgggggctttgtgtggccagtgtggctccctacagggtggagcggccgagggtcccgcagcccctgatgtggtggtcgtgctggaggaggaggccttggatgatgcactggccaacccctatgtgatgggagtgggcctgcccggtcaggcggcccctggagaaggagggcaggctgcatcggacgccctgggtggttatggctcgaaagaagaattgaactgtgaggcagagggtggcctggttcccgcggacaggaagaacaccagcacgagggtccggccccactctgggaaggtggccggctatgtcccagaaaccgtccctgaagaaaccggacctgaggcgggctcgtcagcccctggcattggaggtgccgcagaggaggtgggaaagacgcttttgtcattggaggggaagcccttggaagccagcagggccttgccagcaaagcccagggcctttactttataccctcggtcgttctccgtggaaggccgagagattccagtgtccgtgtaccaggagcctgaggggtcagggttggatgaccacaggataaagaggaaagaggacaatctctctctgtcgtgtgtaattggctcctctgggagtttctcccagagaaaccaccttccgtccagcggcacctccacgccttcttccatggtcgacatcccacctcctttcgacctggcctgcatcaccaagaagcccatcacaaagagctctccctcactcctgatcgagagcgactccccggacaagtacaagaagaagaagtcatcctttaagcgcttcctggcactgacgtttaagaagaagacggagaacaaattgcatgtggatgtgaacgtgtcttcctctaggtcctcttcagagtccagctaccacgggccttccaggattctggaagttgaccggagaagcctcagcaactcccctcagcttaagtctcggactgggaagctccgggcttctgaatccccctcctccctcatcttttatagagatggcaagaggaaaggtgtccccttcagcaggacggtgtccagagtggagtcctttgaagaccgctcccggccgcccttcctgcccttgccactgaccaagccacggtccatctccttccccagcgctgacacttcagactatgagaacattccagccatgaactcggactatgagaatatccagattccaccccggagacctgccagggctggcgcgttcacgaagctgtttgaagatcagagcagagccctgtccacagcaaacgaaaatgatggctacgtggacatgagcagcttcaacgcctttgagagcaaacagcagagtgcagaccaggacgcagaaagcgcctacacagagccctacaaagtctgtcccatctcgtcggcagcccccaaagaggaccttacgtcggatgaagagcagagaagctcggaggaggaggacagtgcttcaagagaccccagtgtcacccacaaggtggaaggacagtccagagcccttgtcatcgcacaggaactgctatcttcagagaaagcatacgtggagatgctccagcacttaaatctggatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttcctggcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatggagaaagtgccctacgctctaaagattgagacttccgagtcctgcctgatgctgtctgcgagccctcttcggaaacgtcgtaaaagaaagaagaaagaagaagaaatggaaactctgggtaaagatataactcctatcaatgaagatattgaagagacaaatattgcttaa

SEQ ID NO: 74 - DNA, 3118 bp, Artificial Sequence
  Description of Artificial Sequence: Synthetic polynucleotide
cagcagctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccagggtcccttgcggcctcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 75 - DNA, 417 bp, Artificial Sequence
  Description of Artificial Sequence: Synthetic polynucleotide
atgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggagaatcgggaccagtattcacatctgctaagtgatcattttctgccataccaaggtcataattccttccgtgagaaatattttagtggggtaacaaaaagaattgccaaggaagaaaaatccacccaggaatga

SEQ ID NO: 76 - DNA, 3532 bp, Artificial Sequence
  Description of Artificial Sequence: Synthetic polynucleotide
cagcggctcccatcgcggctcccgggagctaagcgagacggcgacggcggcagtcgtccctccccacgcgggcgcgcgggcatgcggacacccactcggccggtccaggccctcaggctcccggaagcggaaggggagagcggcccggcctgggcggcggcgccggaggaggcggaggtggcgcggcaggaggaggggaaagagctgctggcggtcgggagagcggcggcagcgagaggcgagccagcggcgacgaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaatactagttaaatggctttcacttaagaacttaagattttgttacatatttttaaatcttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaagaggagcaaatgactcaatctgatttagatggaagtttctactgtatagaaatcaccattaatcaccaacattaataattctgatccatttaaaatgaattctggctcaaggagaatttgtaactttagtaggtacgtcatgacaactaccatttttttaagatgttgagaatgggaacagtttttttagggtttattcttgaccacagatcttaagaaaatggacaaaacccctcttcaatctgaagattagtatggtttggtgttctaacagtatcccctagaagttggatgtctaaaactcaagtaaatggaagtgggaggcaatttagataagtgtaaagccttgtaactgaagatgattttttttagaaagtgtatagaaactattttaatgccaagatagttacagtgctgtggggtttaaagactttgttgacatcaagaaaagactaaatctataattaattgggccaacttttaaaatgaagatgctttttaaaactaatgaactaagatgtataaatcttagtttttttgtattttaaagataggcatatggcatattgattaacgagtcaaatttcctaactttgctgtgcaaaggttgagagctattgctgattagttaccacagttctgatgatcgtcccatcacagtgttgttaatgtttgctgtatttattaattttcttaaagtgaaatctgaaaaatgaaatttgtgtgtcctgtgtacccgaggggtaatgattaaatgataaagataagaa

SEQ ID NO: 77 - DNA, 1430 bp, Artificial Sequence
  Description of Artificial Sequence: Synthetic polynucleotide
atgcgctgggcggccgccaccctccgtggcaaggcgaggccccgggggcgggccggggtcaccacgcctgccccagggaaccgcacagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataa

SEQ ID NO: 78 - DNA, 11600 bp, Artificial Sequence
  Description of Artificial Sequence: Synthetic polynucleotide
atggcggcgcgagtgctgcgcgcccgcggagcggcctgggccggcggcctcctgcagcgggcggccccctgcagcctcctgcccaggctccgattcaagaatggctttgtttaaattgccaaacccagagagcaatatcaggacagcttggagacatacgcaaaatgccacctgcaccatcaggacccaaagcatctcctatgcctgttcctacagaatcatcatctcagaaaacagcagtgcctccccaagtaaaattagtgaaaaagcaagaacaagaagtaaaaacggaagctgaaaaagtcattctggaaaaagtaaaggaaacactatcaatggaaaaaattcctcctatggtaaccacagatcaaaaacaagaagagagtaaactagagaaagacaaagcttcagctcttcaagaaaaaaagccactccctgaagaaaaaaaactaatccctgaagaagaaaagatacgttctgaagaaaaaaagccactcctagaagaaaaaaagccaacccctgaagacaaaaagctactcccagaggcaaaaacatcagccccagaagaacagaaacatgacttacttaaatctcaagtacaaattgctgaagaaaagcttgaaggcagagtggctccaaagacagtgcaagaagggaaacaaccacagaccaagatggaaggtttaccatctggcacacctcagagtttacctaaagaagatgataagacaaccaaaacaataaaagaacagccacagccaccatgcacagcaaaacctgatcaggtggaacctgggaaagaaaaaacagaaaaggaagatgacaaatcagacacctcaagttctcagcagcctaaaagcccccaaggtctgagcgacacgggatattcttccgatggaatatcaagctcacttggtgaaattccaagtcttattccaactgatgaaaaggatattctcaagggactcaaaaaggactctttttcacaagaaagcagcccttccagcccctcagatttggctaagttagaaagtacagtcctatctattttggaagctcaagcaagtacacttgctgatgaaaagtcagaaaagaaaacacaaccccatgaagtttctcctgaacagcctaaagaccaagagaaaactcagagtttatctgaaaccttggaaattactatttcagaagaggagatcaaagagagtcaagaagaaaggaaagacacttttaaaaaagatagccaacaagatattccttccagcaaggaccataaagagaagtctgagtttgttgatgacataactactagaagagagccttatgattcagttgaagagagtagtgaaagtgaaaactcacctgttccacaaagaaaacgaagaactagtgttggctcatcaagcagtgatgagtataaacaggaagacagccaaggatcaggggaagaggaggacttcattcgaaaacaaatcatagaaatgagtgctgatgaagatgcttcaggttctgaagatgatgagttcatcagaaaccagctcaaagagattagtagcagtactgagagccagaagaaggaagaaacaaagggaaaaggcaaaataacagcagggaaacacagacgactgactcgaaaaagtagcacaagcattgatgaagatgcaggaagacgtcactcatggcatgatgaagacgatgaagcatttgatgaaagtcctgaacttaaatacagagaaactaaaagtcaggaaagtgaagaacttgtagttactggaggaggagggctacgccgatttaaaacaattgagctcaacagtacaatagcagataaatattctgcagagtcatcacagaaaaaaacaagtttgtattttgacgaagagccagaattggaaatggaaagcctgacagactcacctgaagataggtcaaggggagagggatcttcgagtctgcatgcttccagcttcactcctggtacatcccctacatcagtatcatcacttgatgaggacagtgacagtagcccgagtcacaaaaaaggagagagcaaacagcaacgcaaagctcggcacagaccacatggccctcttttgcctactattgaagattcttcagaggaagaagaattgagagaggaagaagaattattaaaggagcaagaaaagcagagggaaatagaacagcaacaaagaaagagttctagtaaaaaatcaaagaaagacaaagatgaacttcgagctcagagaagaagggaaaggccaaagacaccacctagtaatctctctcccattgaagatgcatctccgacagaagagttacgtcaggctgcagaaatggaggagctccatagatcttcttgttctgaatattcacctagcatagagtcagacccagaaggttttgaaataagcccggaaaaaataatagaagtacaaaaagtttataaattgcccacagctgtttcattatactcaccaacagatgagcaatctattatgcagaaagaaggtagccaaaaggcgttaaaaagtgctgaggagatgtatgaagaaatgatgcataaaacacacaaatacaaagcttttccagctgcaaatgaacgagatgaagtgtttgaaaaagagcctttgtatggtgggatgctaatagaggattatatttatgaatctttagtagaagacacgtacaatggatcggtagatggcagtctgctaacaaggcaagaagaagaaaatggatttatgcagcagaaaggaagagagcaaaagataagactttcagaacagatttatgaagatcctatgcagaaaattacagacctccagaaagagttttatgagttagaaagcttacattctgttgtgcctcaggaagatattgtttcaagctcttttatcatcccagaaagccatgagatagtggacctgggtactatggtaacttctacagaagaagaaaggaaactactagatgctgatgctgcctatgaagaacttatgaagaggcaacagatgcaattaacacctggatctagcccaacccaggcccccattggtgaggatatgacagagtccaccatggactttgacagaatgccagatgcctctttgacatcaagtgttctctcaggagcgtctcttacagattcgaccagcagtgcaacactctctatcccagatgttaaaataacccaacatttttcaacagaagaaattgaggatgaatatgtaaccgattatacaagagaaattcaagagataattgcccatgaatcgctgattttgacctactcggagccttcagaaagtgctacatctgtcccaccctctgacacaccttctctcacatcatctgtttcttcggtctgtaccacagatagctcttcacccattactaccctggatagcataaccacagtttatacagagccagtggacatgataactaaatttgaagattctgaggaaatttcttcatcaacttattttccaggcagcattatagactatccagaagaaataagtgtatctttagatcggactgccccaccagatggtagagctagtgctgatcatattgttatttccttatctgatatggcatcttctatcatagaatctgtagtacctaaacctgaagggccagttgctgacactgtttctactgacttacttatatctgaaaaggacccagtgaagaaagccaagaaggaaactgggaatggaatcattctggaagttttggaagcttacagagataaaaaggagttggaggccgaacgaacaaaaagtagcttatccgaaaccgtgtttgatcacccaccttcttctgtaatagcccttccaatgaaagagcagctttcaactacatactttacatctggagagacctttggtcaggaaaaacctgcatctcagttaccatctggcagtccttctgtttcctctcttccagctaaacctcgcccattctttagaagttcttctttggatatatcagctcaacctcctccccctcctccccctccccctcctcctcctcctccaccaccaccccctcctcccccaccacttcctccaccaacttcacctaaaccaactattcttcctaaaaaaaagttaacagttgcatctccagtgactacagctacacctctgtttgatgctgttactactctagagaccacagctgttctgagaagtaatggattacctgttacaagaatatgtactactgcacctcctcctgttcctcctaagccatcttcaattccatctggacttgtatttacccacaggcctgagccaagcaaacctccaatcgcccccaaaccagtgattcctcagcttccaacaactacacaaaaaccaacagatatacaccccaaaccaacaggcctatctttaacttcaagtatgaccttaaatttagtgacttcagcagattataaattgccttcccctacctccccactttccccacactccaacaagtcttcaccaagattttccaaatccctcacagaaacttatgtagttattacattgccatctgaaccagggactccaacagattcttctgctagtcaagcaattaccagttggcccttgggatcaccctccaaagatctggtttctgttgaacctgtgttttctgtagttcctcctgtgacagctgtagaaattccaatttcttcagaacagaccttctacatctctggagctttacagacattttctgctacccctgtcacagcaccctcttcatttcaagcagctcccacatcagttacacagtttctcactactgaagtttccaagactgaggtttcagcaaccagaagtacagctcctagtgttggtctcagcagcatttccataacaattcctccagagcctcttgctctagataacatacatttagagaagcctcagtataaagaagatggaaaattgcaacttgttggtgatgtaattgatttgcgtacagtaccaaaggtagaagttaaaacaactgataaatgtattgatctttctgcttctacaatggatgtgaaaaggcagatcacagcaaatgaagtttatgggaaacaaattagtgctgtccaaccctctattataaatcttagtgtgacatcatcaatagtgactcctgtatctctggccactgagacagtgacctttgtcacatgcacagctagtgcaagttacactacaggcacagaaagcctagtgggtgcagaacatgcaatgacaacaccactccaacttacaacatcaaagcatgctgagcccccatacaggataccaagtgaccaggtctttcctatagctagggaagaagcaccaataaacttatctctaggtactccagcacatgcagtgacattggctattacaaaacctgtcactgtgcctcctgttggtgtcacaaatggatggactgatagcaccgtatcccagggaatcactgatggggaagtagtggatctcagtacaaccaagtctcacagaacagtcgtaacaatggatgagtctacttcaagtgtgatgaccaaaataatagaagatgaaaaacccgttgatttaaccgcagggagaagagctgtgtgctgtgatgtggtttataaattaccatttggaaggagctgcacagcacagcagcctgcaactactcttcctgaggatcgttttggttatagggatgaccactatcagtatgatcgatcagggccatatggttatagagggattgggggaatgaagccttccatgtctgacacaaatttagcagaagctggacattttttctataaaagtaagaatgcttttgattattctgaaggaactgacacagcagtagatctgacttcagggagagttactacaggtgaggtaatggattattcaagcaagactacaggtccatatccagaaacacgacaagtcatttcaggagctgggattagtaccccacagtattccacagcaagaatgacaccaccaccaggaccccagtattgtgtggggagtgttttgaggtcatctaatggtgttgtctattcttcagtagcaactccaacaccctctacatttgctatcaccacacaacctggctccattttcagcaccacagtgagggatttgtctggtattcatacggctgatgcagtgacttcattacctgccatgcaccatagccagccaatgcctagatcatattttataacaacaggtgcatctgaaacggacattgcagtaactggtattgatatcagtgccagtttgcaaactattactatggagtctcttactgctgagacgatagactctgttcccactttaaccacagcatccgaagtgtttcctgaagtggtgggagatgaaagtgctcttttaattgtccctgaagaagataaacaacagcagcagctagacttggagcgtgagctcctggaactggagaaaattaagcaacagcgctttgctgaggaattggagtgggaacgtcaggaaattcaaaggttccgagaacaagaaaagatcatggttcagaaaaagttggaggagctgcagtctatgaagcaacaccttctctttcagcaagaagaagagcggcaagcccagttcatgatgaggcaggagacgttagctcagcaacagttacagcttgagcagatccaacagctgcaacaacagcttcaccagcagctggaggagcaaaagattcggcagatctaccagtataactatgacccttctggaactgcttctccacaaaccactacagagcaggcaattttggaaggtcagtatgctgctctggaaggcagtcaattttgggcaactgaagatgcaaccaccacagcttcagctgttgtggcaattgaaataccacaaagccaaggatggtacaccgttcagtctgatggtgttactcagtacattgccccacctggtatcctgagcactgtttcagaaatacctctaacagatgttgttgtgaaagaggaaaaacaacccaaaaagagaagttctggagctaaagtccgaggacagtatgatgacatgggagaaaatatgacagatgatccccgaagttttaaaaagatagtggacagtggtgtacaaacggatgacgaagatgccacagatcggagctatgtgagtaggagaaggagaactaaaaagagtgtggatacaagcgtccaaactgatgatgaagatcaggatgagtgggatatgcctactagatcaaggaggaaagctcgtgtagggaaatatggtgacagcatgacagaggctgacaagaccaaacccctttccaaagtctccagcatagcagttcaaacggtagcagagatatctgtgcaaactgaaccagttggaaccataagaacaccctccatacgggcacgagtggatgccaaggtagaaataattaaacacatttcagcacctgaaaagacttacaaagggggcagtttaggatgtcaaacagaagcagattcagacacacaaagtcctcaatatctgagtgccacatctccacccaaagacaagaaacgcccaacacctttagagattggttattcatctcacctccgggcagattccacagtacagctggctccttccccacccaaatcccccaaagtcctttactcacccatctcaccactttcaccaggcaaagccttagaatcagcctttgtaccttatgaaaaacccctccctgatgatataagtccacagaaagtactgcatccagatatggctaaagttcccccagcaagtcctaagacagccaagatgatgcagcgttctatgtctgaccccaagcctctgagtccaacagcagacgaaagttccagggctccttttcagtataccgagggctatacgactaaaggttctcaaaccatgacatcctctggagcccagaaaaaagttaaaagaactctgccaaatccacctcctgaggagatttccacaggaactcaatccacattcagcacaatgggcacagtttccaggagaaggatctgcagaaccaacacaatggcacgagccaagattctccaggacatagacagagagcttgatcttgtggaaagggagtctgcaaaacttcgaaagaaacaagcagagcttgatgaagaagaaaaggagattgatgctaagctacgatacctggaaatgggaattaacaggaggaaagaggccctattaaaggagagagaaaagagagaacgagcctacctccagggagtagctgaggatcgtgattacatgtctgacagtgaagtgagtagcacaagaccaacccgaatagaaagtcagcatggcattgagcgaccaagaactgctccccaaactgaattcagccagtttataccaccacaaacccaaacagaatctcaactagttcctccgacaagtccttacacacaataccagtactcttcccctgctcttcctacccaagcacccacctcatacactcaacagtctcattttgagcaacaaactttgtaccatcagcaagtttcaccttatcagactcagccaacattccaagctgtggcaacaatgtccttcacacctcaagttcaacctacaccaaccccacagccttcttatcagttaccttcacagatgatggtgatacaacagaagccacggcaaactacattatatttggagcccaagataacctcaaactatgaagtgattcgcaaccaaccccttatgatagcacctgtttctacggataacacatttgctgtttcccatcttggtagtaagtacaatagtttagacttgagaataggtttggaggaaagaagtagcatggcaagcagtccaatatcaagcatatctgcagattctttctatgcagatattgatcaccatactccacgaaattatgtcctaattgacgacattggagagatcaccaaaggaacagcggcattaagcaccgcatttagccttcatgaaaaggatctgtcaaaaacagaccgtctccttcgaaccactgagacacgccggtctcaagaagtgacagatttcctagcacctttacagtcttcctctagattgcatagttatgtgaaggcggaggaagacccaatggaggatccttacgagttaaagcttctgaaacatcagattaaacaggaatttcgtagagggacagagagcttagatcaccttgctggtctttctcattattaccatgctgatactagctacagacattttccaaaatctgagaagtatagcatcagtagactcacacttgaaaaacaagcagcaaaacaactgccagcagccatactttatcaaaagcagtcaaagcataagaaatcactaattgaccctaaaatgtcaaaattttcacctattcaagaaagtagagaccttgaacctgattattcaagctatatgacttctagcacttcatctattggtggcatttcctccagggcaaggctccttcaagatgacatcacttttggcctcagaaaaaatattacagaccaacaaaaatttatgggatcttctcttggcacaggactgggcacattaggaaataccatacgctcagctctgcaggatgaagcggataagccatacagtagtggcagcaggtccagaccttcctccagaccttcctctgtctatgggcttgatttatcaattaaaagggattcttctagctcttccctaagactgaaagctcaagaggctgaagctctagatgtttcctttagtcatgcatcatcctctgccagaactaagccgaccagtttgccaattagtcaaagtagaggaagaataccaattgtggcccagaattctgaagaagaaagcccactcagtcctgttggccagccaatgggaatggccagggctgcagctggacccctgccaccaatatctgcagacaccagggatcagtttggatcaagccactcattgcctgaagttcagcaacacatgagggaagaatcacggactcgaggctatgaccgtgacatagcattcatcatggatgacttccaacatgccatgtcagacagtgaagcctatcatctgcgtcgtgaggaaacagattggtttgataaacccagggagtctcgtttggaaaatggacatggtctggaccgaaaactgccggaaagattggtccactctagaccactcagtcaacatcaagagcaaattatacagatgaacgggaaaactatgcactacatctttcctcacgcaaggataaaaataacaagagactcaaaggatcacacagtttcaggtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaagtaaaagacgcaaataa

SEQ ID NO: 79 - DNA, 177 bp, Artificial Sequence
  Description of Artificial Sequence: Synthetic polynucleotide
atggccaccaaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttga

SEQ ID NO: 80 - DNA, 3583 bp, Artificial Sequence
  Description of Artificial Sequence: Synthetic polynucleotide
caggggcggaggtgacagcgggctggggactggcggctgcaactgcctgccgcgccgagggaccgccgggcggcggaaagcaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaat

SEQ ID NO: 81 - DNA, 9454 bp, Artificial Sequence
  Description of Artificial Sequence: Synthetic polynucleotide
cgggatggcaactgcggtcaccctgctaaagtcggggcgggggcggcggtcctccccctcaccccccccagtccgagcgccgccgccgccgccgccgccgccgccgcggccgctcagtaacacgtccccaggagactcgcaggagcaacacgtgatgtgtctacttatcaggtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgctatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccagggatcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttaggttatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttgaagtgtttgtgttttaatttaatatgtttataagcatgtataaacatttagcatatttttatcataggtctaaaaatatttgtttactaaatacctgtgaagaaataccattaaaaaactatttggttctgaattcttacta

SEQ ID NO: 82 - DNA, 2297 bp, Artificial Sequence
  Description of Artificial Sequence: Synthetic polynucleotide
aaagcttcatgaaacctcctcgtctgtgcacgaacaggtggccgactctggagcccaggctgttgctttccagtctggtggtgaatcctccatagtctgctctgtgttctcgttttgcccaagacctttggctagagcagaacataaaagattctttccaaaaagtgacactgagcagatatggaaaatatggacataagaatttacagttaagaaaaggctgtaaaagtgtggatgagtgtaagggacaccaaggaggttttaatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacctatcttaacaacttactgaacataagaaaatttacactagagagaaagcctacaaatgtgaagaatgtggcaaagcctttaaccagttttcaacccttattacacataagataattcatagcggagagaaaccccacaaatgtgaagaatgtggcagagcttttaaccagtccgcaaagctcactgaacataagttaattcatactggagaaaaaccctacaaatgtaaagaatgtggaaaagcttttcaccgatactcaatccttagtacacataagaaaattcatactggggagaaaccccacaaatgtggagaatgcggaaaagcctttaactggtcctcaactcttattacacataagataattcacagtggagaaaaaccctacaaatgtgaagaatgtggcaaagcttttaaccagtcctcacaccttatgagacataagaaaattcatagtaaagagaaaccctacaaatgtgaacagtgtggcaaggtctttaagaagtcctcaactcttactgcacataagatcattcatactggagagaaaccttacaaatgtgaggaatgtggcaaaggttttagccaactctcaaaccttactaaacacaagaagattcatactagagagaaaccctacaaatgtgaagaatgtggcatatcttttaaccagttctcacaacttgctatacataagatgattcacacttgaatgaaaccctacaaatgtgaacgatgtggcagttgttttaactagttctcgaactttactatgcataagaaaattcaaactggagagaaactctacaaatgtgaagaatgtggcaaagcttttaaccaagtctcaacacttactatacataagataatttatactggagcaaaaccttggaaattcaaagaatgtggtaaaacttacaatcctcaaaacttcttacacctaaaattcatgcaggagagaaacaccacaaatgtgaaaaatttggtaaattctttaacaagtcttcaaccctttctgcacataatataattcatactggagagaaaccccacaaatatgaagaatgtggtaatgcttttaaccaattctcaaatcttactaaacaaaattaatactgaaaatgttacaaaccagaaaaatgtgaaaatgattttaacaaaaccttcaaatttttctaaacataaaggaaatcatactggtaagaaattataaaaatgtgaagaatgtgacaaagcctttaaatggttgtcacacttgattgtaggtaagataattcatactggcagaaactcccagaagtgtgaagaatatggcaaaactttaattcctataccttattgcacaggaaagcatttatacttcagaaaatgttgtactgatataaagaatgtagaaaagccattaatatgtgcttacatcttattcaacattagagagttagtacttaataaa

SEQ ID NO: 83 - DNA, 810 bp, Artificial Sequence
  Description of Artificial Sequence: Synthetic polynucleotide
agcagcggaacgattcgattcttctcagcaccaagttgcgctcccaatctctcagagctgggctcgcgggaggccgctcgtgcaaaacctaggctgagctcccctgcgcggagctgtgagccctggaacaccgtggtctgcttctcaggacgcgcaaacagtgaagccagtcccgcccgggtgagccgcgggggcctctgggaagcgtcgcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttggtgagttcttcatatattaaggattcattcattcatagactcatttattgaaggctgtctgtgtaacaggcacaatcctaggtgcttgggatatagcagtgaacaagagacaaaccccctactatcatggtacttacatttttgtgggctggataataaacaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataa

SEQ ID NO: 84 - DNA, 5104 bp, Artificial Sequence
  Description of Artificial Sequence: Synthetic polynucleotide
atggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaaggctccccaggaagctctcagtctgggagcaggcacagttctccccgagccttgatacatggcagtatcggtgatattctgccaaaaactgaagaccggcagtgtaaagctttggattcagatgctgttgtggttgcagttttcagtggcttgcctgcggttgagaaaaggaggaaaatggtcaccttgggatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtag

SEQ ID NO: 85 - DNA, 935 bp, Artificial Sequence
  Description of Artificial Sequence: Synthetic polynucleotide
atggggaagcgacagcaccaaaaggacaaaatattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctag

SEQ ID NO: 86 - DNA, 1818 bp, Artificial Sequence
  Description of Artificial Sequence: Synthetic polynucleotide
atgggcctccccgagccgggccctctccggcttctggcgctgctgctgctgctgctgctgctgctgctgctgcagctccagcatcttgcggcggcagcggctgatccgctgctcggcggccaagggccggccaaggattgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctgctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatag

SEQ ID NO: 87 - DNA, 120 bp, Artificial Sequence
  Description of Artificial Sequence: Synthetic polynucleotide
atgatttcggccgcgcagttgttggatgagttaatgggccgggaccgaaacctagccccggacgagaagcgcagcaacgtgcggtgggaccacgagagctgtcctctacaagcctggtga

SEQ ID NO: 88 - DNA, 5718 bp, Artificial Sequence
  Description of Artificial Sequence: Synthetic polynucleotide
atgttctacgcacattttgttctcagtaaaagagggcctctggccaaaatttggctagcggcccattgggataagaagctaaccaaagcccatgtgttcgagtgtaatttagagagcagcgtggagagtatcatctcaccaaagatgtttgggctgaaggtgaagaagaagagaaataaggcagagaaggggttaatcctagccaacaaggctgcgaaagatagtcaaggtgacactgaagcactgcaggaggagccttctcaccaggaaggaccgagaggagatttggtccatgatgatgcttctatctttcctgtcccctcagcttctccaaagagaagatcaaaactgttgactaagatccatgatggggaggtcagatcccaaaattatcaaattgccataaccatcaccgaggctcgccagctggtgggtgagaacattgacccagttgtgaccattgagattggggatgagaagaagcaaagcacagtgaaggaaggaaccaacagcccattttataatgaatactttgtcttcgacttcattgggccccaagtgcatctttttgacaagatcatcaaaatctccgtctttcaccacaagctgataggaagtgtactgattggctctttcaaagtagacctggggaccgtgtacaaccaacctggtcatcagttctgcaacaagtgggccctgctcacagaccctggtgacatcaggactggcaccaaggggtacctgaaatgtgacatcagtgtcatgggaaaaggtgatgtcttgaagaccagccctaaaacttctgacaccgaggagccaatagaaaagaaccttttgatccccaatgggtttccactggagagaccgtgggccagattctatgtgagactctacaaagcagaagggttgcccaaaatgaattcaagcatcatggcgaacgtcaccaaggcatttgtgggtgacagtaaggacctggtggatccctttgtggaggtctcctttgctgggcagatggggcgaaccacagtgcagaagaactgtgctgatcctgtgtggcatgaacaggtgatcttcaaggaaatgttccctcccttgtgtcggagggtgaaaatccaggtgtgggatgaaggcagcatgaatgacgtagccctggcaacccatttcattgacctgaagaaaatctccaacgaacaggatggagacaaaggctttctgcccacctttgggcctgcctggattaacctgtatggctcgcccaggaaccacagtctgatggatgactaccaggaaatgaacgaaggctttggggaaggtgtgtcattcaggggcagaatcttggtagaaattgctgtggaaatcctctcaggacgggcacaggaatctaaattttccaaggccctgaaggagctcaagttgccttccaaggacaaagactccaaatcttccaaaggtaaagacaaggctgacaaaactgaagatggaaaatcccaacaggcttcaaacaaaactaactcaaccgaggtggaggtggaatcgttcgatgtccccccggagattgtaccagaaaaaaatgaggaatttttactctttggagcattttttgaagctaccatgattgaccggaagattggagataaacccatcagctttgaagtttctattggtaattttggaaacctgattgatggaggatcccatcatgggagtaagaagtcagctgaatcagctgaagaagacctccttccactgcttcacgaagggcaaggggatgtggcccatgatgttcccattcctatggcctccaccactcacccggagaagccactggtgacagaagggaacaggaattacaactatttgccatttgaggctaagaagccctgtgtctatttcatcagctcttggggagaccagaccttcaggctgcactggtccaacatgctggagaaaatggcagacttcctggaagaaagtatagaagaagtgagagaattgatcaagatttcacaggaggcacctgaagagaaaatgaaaacagtgctcagtgacttcatcagtcggagcagtgcctttatctctgaagcagaaaaaaagcccaagatgttgaaccaaaccactttagataagaagcgacttacgctctgctggcaggagctggaagcaatgtgcaaggaggccaaggggatcattcagcagcagaagaaaaagttatctgttgatgaaatgattcacgaagcccaaaactttgtggaaaaaatccgctttcttgttgatgagccccagcacactatccctgacgttttcatctggatgctcagcaacaacaggagagtggcctatgcccgcatcgcctccaaagacctcctctattcccctgtcgcggggcagatgggcaaacactgcggcaagatcaaaactcacttcctcaaacctcctgggaaacgaccggctggttggtctgtgcaagcaaaagtcgacgtgtacctgtggctgggctccatcaagcatgccagtgccattttggacaacttgccagtaggctatgaagcagaaatgtcctccaaaggggctggcaccaatcaccccccatctaacctgctctaccaagaacagcatgtttttcagctgagggctcacatgtaccaagcccggggcctcatcgcagctgacagcaatggactttcagacccttttgccaaagtcacgttcctttctcactgccagacaacaaagataatctcccagaccctctctccgacctggaaccagatgctgctgttcaatgatttggtgctgcatggagatgtgaaggagctggcagagtccccgcccttagtggtggtggagctgtatgacagcgacgctgtggggaagccagaatatttgggtgccacagtggctgctcctgttgtgaagctggctgaccaggactatgagccccccaggttatgctatcaccccatcttttgtgggaatctctctggaggggatctccttgctgtatttgaactgctgcaggttcctccttctgggctgcaaggcctcccacccgttgagccaccagacatcacccagatctacccggttcctgccaacattcggccggtgctgagcaaataccgagtggaggttctcttctggggagttcgggaaatgaagaaggtgcagctcctctctgtggatcggcctcaggctctcattgagtgcggaggacaaggtgtgaagtcctgcgtgatccagagctacaagaacaacccgaacttcagcatccaggcagacgctttcgaagtggaactgcctgagaacgagcttctgcacccgccactgagcatctgcgtggtggactggagagcttttgggaggagtacccttgtgggcacctacaccatcaactacttgaagcagtttttgtgtaaactcagagagccccttgcccccatcacacaggtggatggaacccagcctgggcacgatatttcagattcgctaacagccactgagtcctctggagcccacagctcctcccaggatcccccagcagatcacatttatgtggatgttgagccacctcccacagtggtgcccgactctgcccaggcccagccggccatcctggttgacgtccctgactcatccccgatgctggagcctgaacacacacctgtagcccaggagccaccaaaagatggaaaacctaaggatcccaggaagccttcccggaggtccactaagaggagaaagaggaccatagcagatgaatctgctgaaaacgtgattgactggtggtctaagtattatgcctccctgaagaaagcccagaaggcaaaggagagaaatcccaagggaaaaaaaggcaatacagaggcaaagccagatgaggtagtggtagatatagaagatgggccaaagaagaagaaagacaaaatgctcaagaagaaacccaaagatgatggaatccccaacctggccatcttgcagatatatgacggtgatctcgagagtgaattcaacaattttgaagactgggtgaaaacttttgagctcttcagaggcaagtctacggaagatgaccatggtcttgatggagaccgagtcataggaaaatttaagggctccttctgcatctacaaaagcccccaggattctagctctgaggacagcgggcagctgagaatccagcaagggattccgcccaatcaccctgtcacagtgctgatcagagtatacattgtcgcggcatttaatcttagtccagctgatccagatggcaaatcagatccctacattgtgatcaagcttggcaagacagaaatcaaagaccgggataaatacatccctaaacaactgaacccagtatttggaaggtcatttgagatccaagccacattcccaaaagagtccctgctctccatcctgatctatgaccatgacatgattggcacagatgaccttattggtgagaccaagatcgacctggagaaccgcttctacagcaaacaccgagccatctgtggcttgcagagccagtatgagatagaaggatacaatgcctggagagacacgtccaaacccaccgaaatcctcactaagctctgcaaagacaacaagctggatggaccctactttcaccctgggaaaatacagataggaaaccaagtcttttctggaaaaactatcttcactgaagaggacactgatgagacagtggagtcttatgaacacctggccctcaaggttttacactcttgggaggatatcccggaagtcgggtgtaggctggttcctgaacacatagaaactcggccactgtaccacaaggataagccaggaatggagcagggccgcctgcagatgtgggtggacatgtttcccaaggatatgcctcaacctggacctcctgttgacatctctccaaggcgacccaaaggatacgaattgagagtgaccatctggaacactgaagatgtcattttagaggatgagaatatcttcacaggccaaaaatcaagtgatatttatgtgaaagggtggttaaagggcttggaggatgacaagcaggagacagatgtgcattacaactccctgactggagagggcaacttcaactggcgcttcctgtttccctttcagtatctcccagctgagaagcaaatggtcattaccaagagggagaacatcttctctttagagaagatggagtgtaagactcctgctgtgttggtgctgcaggtttgggattttgaaaggctgtcctcagatgacttcctgggcaccctggaaatgaacctcaacagtttccctcgagcagctaagtctgccaaagcctgtgatcttgccaagtttgaaaatgcaagtgaggagaccaagatctctatattccagcaaaaacgtgtgcgtggctggtggcctttttctaaaagcaaagaactcacaggcaaggttgaagctgagttccacctagttacagcagaagaagctgagaaaaatcctgttggaaaagcccgaaaggagccagagcccctggccaagcccaaccgcccagacacctccttttcgtggttcatgagcccctttaagtgcctgtactacctcatctggaagaattacaaaaagtacatcatcattgctttcattctcatcatcctcatcatcttcctcgtccttttcatctacaccttgccaggagccatcagccgaaggatcgttgtgggctcatag

SEQ ID NO: 89 - DNA, 1911 bp, Artificial Sequence
  Description of Artificial Sequence: Synthetic polynucleotide
atgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggactccaacatttgtgctgtgtttgctgtacaaggaggaaaagtgggaagaaagcatggcataaaaagggggaggagacccagcataagaagcccagctcagcgggccagaggaccctggatccatgagagtaagcatccggcctttgcaaagcaacagataaacttggagatgcccaactccagagcgacaacagagttagcctgggtctgcagctccacctcaagaaaaaagaagtgggcaaggtccctgactctttccactgctccactgagccccccaccatccttggtgcactgtgaagattgttcttgcctgcctggctgccattcgggtgacctctacaatctggccccagcagaaagaacttgctag

SEQ ID NO: 90 - DNA, 2853 bp, Artificial Sequence
  Description of Artificial Sequence: Synthetic polynucleotide
atgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagattgcgccaggctgagcgaagccgccaatctgctgagttggacaaccggctcttcaaacaggactttggagacaagatcaacagtctgcagctggaagtcgaggagctcaccaggcagcggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagatgaaaactctgccgctgtttgtgtgcatctgtgcactgagtgcttgcttctcgttcagtgaaggtcgagaaagggatcatgaactacgtcacagaaggcatcatcaccaatcacccaaatctcactttgaattaccacattatcctggactgctagctcaccagaagccgttcattagaaagtcctataaatgtctgcacaaacgctgtaggcctaagcttccaccttcacctaataacccccccaaattcccaaatcctcaccagccacctaaacatccagataaaaatagcagtgtggtcaaccctaccttagtggctacaacccaaattccatctgtgactttcccatcagcttccaccaaaattactacccttccaaatgtgacttttcttccccagaatgccaccaccatatcttcaagagaaaatgttaacacaagctcttctgtagctacattagcaccagtgaattccccagctccacaagacaccacagctgccccacccacaccttctgcaactacaccagctccaccatcttcctcagctccaccagagaccacagctgccccacccacaccttctgcaactacacaagctccaccatcttcctcagctccaccagagaccacagctgccccacccacacctcctgcaactacaccagctccaccatcttcctcagctccaccagagaccacagctgccccacccacaccttctgcaactacaccagctccactatcttcctcagctccaccagagaccacagctgtcccacccacaccttctgcaactaccctagacccatcatccgcctcagctccaccagagaccacagctgccccacccacaccttctgcaactacaccagctccaccgtcttccccagctccacaagagaccacagctgccccaattaccacacctaattcttccccaactactcttgcacctgacacttctgaaacttcagctgcacccacacaccagactactacttcggtcactactcaaactactactactaaacaaccaacttcagctcctggccaaaataaaatttctcgatttcttttatatatgaagaatctactaaacagaattattgacgacatggtggagcaatag

SEQ ID NO: 91 - DNA, 2080 bp, Artificial Sequence
  Description of Artificial Sequence: Synthetic polynucleotide
ggaggtgagcaggaaggagacggccgcccagcagcccgtgggcaggcgcggcggagcgagcggggccggcggcgggcgccgagggacgccgaggcctcgggcgggggctggcccggggttccaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataa

SEQ ID NO: 92 - DNA, 2124 bp, Artificial Sequence
  Description of Artificial Sequence: Synthetic polynucleotide
atggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 93 - DNA, 5790 bp, Artificial Sequence
  Description of Artificial Sequence: Synthetic polynucleotide
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaa

SEQ ID NO: 94 - DNA, 2177 bp, Artificial Sequence
  Description of Artificial Sequence: Synthetic polynucleotide
atggcggccgtggaactagagtggatcccagagactctctataacaccgccatctccgctgtcgtggacaactacatccgctcccgccgagacatccgctccttgcccgagaacatccagtttgatgtttactacaagctttaccaacagggacgcttatgtcaactgggcagtgaattttgtgaattggaagtttttgctaaagtactgagagctttggataaaaggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccggctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaagctggcgctggagcagcgctgccgggagctgcgcgcgcggggccggcgcctggaggagacgctgccgcggcgcatcggctccgaggagcagcgcgaggtgctcagcctgctgtgccgcgtgcacgagctcgaggtggagaacaccgagatgcagtcgcacgcgctgctccgcgacggtgcgctccgccaccgccacgaggccgtgcgccgcctggagcagcaccgcagtctctgcgacgagattatccagggccagcggcagatcatcgacgactacaacctggccgtcccgcagcgcctggaagagctctacgaagtgtacctgcgggagctggaggagggcagcctggagcaggccaccatcatggaccaagtggcctccagggccctgcaggacagctccttgcccaaaattaccccagcaggaacctcactgaccccagattctgacctggagagtgtgaagacattgagctctgatgcccagcacctgcagaacagcgccctccctcccctcagcacagagagtgaaggccaccacgtgttcaaggctggtactggggcctggcaggcaaaaagctcctctgtgcccaccccacctcccatccagctcggcagcctggtgacgcaggaggccccggctcaggacagcctgggcagctggatcaactcttcccctgacagcagtgagaacctgtcggagatccccttgtcccacaaagagaggaaggagatcctgactggcaccaagtgcatctgggtgaaggccgcccggcggcgctcgcgggccctgggaaccgaggggcgacacctgctggcacccgcgacagagcgcagcagcctgtccctgcactcactgagcgagggcgacgatgcgcggccaccaggcccactggcctgcaagcggccgcccagccccacactacagcatgctgccagtgaggacaacctgtccagcagcacgggcgaggccccgtcccgggcagtcggacatcatggggacggccccaggccctggctgcgtggccagaagaaaagcctgggcaagaaaagggaggagtcgctggaggcaaagagaaggaagcggaggtcccgatccttcgaggtcaccgggcaagggctctcccaccccaagacacacctcctggggccccatcaggcggagcgcatctcggaccacaggatgccagtgtgcaggcacccagcccctggtatccggcatctgggaaaggtcacgctacctttggccaaagtcaaactccctccaagccagaacacgggcccgggggactcctcacccctggctgttccccccaacccaggtggtggttctcgacgggctacccgtgggccccgcctgccccacggcacaagcacccatggcaaagatggatgctcccggcataactga

SEQ ID NO: 95 - DNA, 6411 bp, Artificial Sequence
  Description of Artificial Sequence: Synthetic polynucleotide
atggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgaaggggaacacggccctgcacatcgctgctctagccgggcaggatgaggtggtccgggagcttgtcaactatggagccaacgtcaacgcccagtcacagaaaggttttacacccctgtacatggcagcacaagagaaccacttggaagtggttaagtttttactggaaaatggagctaaccagaatgtagccacagaagacggcttcacgcctctggcggtagccctgcagcagggccatgagaacgtcgtcgcgcacctcatcaactacggcaccaaggggaaggtgcgcctcccggccctgcacatcgcggcccgcaacgacgacacgcgcacggctgcggtgctgctgcagaacgaccccaacccggacgtgctttccaagacgggattcacgcccctgcacattgcggctcactacgagaacctcaacgtggcccagttgctcctcaacagaggagccagcgtcaatttcacaccacagaacggcatcacgccactgcacatcgcctcccgcaggggcaacgtgatcatggtgcggctgctgctggatcggggagcccagatagaaaccaagaccaaggacgaattgacacctctccactgtgcagctcgaaatgggcacgtgcgaatctcagagatcctgctggaccacggggcaccaatccaagccaaaaccaagaacggcctgtccccaattcacatggcggctcagggagaccacctcgactgtgtccggctcctgttgcaatacgacgcagagatagacgacatcaccctggaccacctgaccccactccacgtggctgcccactgtggacaccacagggtggctaaggtccttctggataaaggggccaaacccaactccagagccctgaatggctttacccccttacacatcgcctgcaaaaagaaccacgtccgtgtcatggagctgctgctgaagacgggagcctcgatcgacgcggtcaccgagtctggcctgacacctctccacgtggcctccttcatggggcaccttcccatcgtgaagaacctcctgcagcggggggcgtcgcccaacgtctccaacgtgaaagtggagaccccgctacacatggcagccagagccgggcacacggaagtggccaaatatttactccagaacaaagccaaagtcaatgccaaggccaaggatgaccagaccccacttcactgtgcagctcgcatcggccacacaaacatggtgaagctcctgctggaaaataacgccaaccccaacctggccaccaccgccgggcacacccccctgcacattgcagcccgtgagggccatgtggaaacagtcctggcccttctggaaaaggaagcatcccaggcctgcatgaccaagaaaggatttacccctctgcacgtggcggccaagtacgggaaggtgcgggtggcagagctgctgctggagcgggacgcacacccgaatgctgccggaaaaaatggcctgacccccctgcacgtggccgtccatcacaacaacctggacatcgtcaagctgctgcttccccggggcggctccccgcacagccctgcctggaatggctacacccctttgcacatcgctgccaagcagaaccaggtggaggtggcccgtagtctgctgcagtatgggggctcagcaaacgccgagtcggtgcaaggtgtgacgccccttcacctggccgcccaggagggccacgcagagatggtggctctgctgctctcgaaacaagccaatggcaacctggggaacaagagcggactcactcccctccatctggtagcacaagaaggccacgttccagtggcagatgtgctgatcaaacacggcgtcatggtggacgccaccacccggatgggctacactcccctccatgtggccagtcactatggaaacatcaagctggtgaagtttctgctgcagcaccaggcagatgtcaatgccaagaccaagctaggatacagccccctgcaccaggcagcccagcagggacacacagacatcgtgactctgcttctgaaaaacggtgcttccccaaacgaggtcagctcggatggaaccacacctctggccatagccaagcgcttgggctacatttctgtcaccgacgtgctcaaggtcgtcacggatgaaaccagtttcgtgttagtcagtgataagcatcgaatgagtttccctgagacagttgatgagatcctggatgtctcggaagatgaaggggaagaactcatcagcttcaaggctgagaggcgggattccagggatgttgatgaagagaaggagctgctggattttgtgccgaagctagaccaagtggtggaatctccagccatccccaggattccctgtgccatgcctgagacagtggtgatcaggtcagaagagcaggagcaggcatctaaagagtatgatgaggactccctcatccccagcagcccggccaccgagacctcagacaacatcagcccggtggccagcccggtgcatacagggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatcatagcactggggcccacgggggcacagttcctgagccctgtaatcgtggagatcccgcactttgcctcccatggccgtggagaccgcgagctcgtggttctgaggagcgaaaacggctccgtgtggaaggagcacaggagccgctatggagagagctacctggatcagatcctcaacgggatggacgaagagctggggagcctggaggagctagagaagaagagggtgtgccgaatcatcaccaccgacttcccgctgtacttcgtgatcatgtcacggctctgccaggactacgacaccatcggtcccgaagggggctccctgaagagcaagctggtgcccctggtacaggcaacgttcccggagaatgccgtcaccaagagagtgaagctggctctgcaggcccagcctgtcccggatgagcttgtcactaagctcctgggcaaccaggccacattcagccccattgtcaccgtggagccccggcgccggaagttccaccgccccattgggcttcggatcccactacctccttcctggaccgacaacccgagggacagcggggagggagacaccaccagcctgcgcctgctttgcagcgtcattggaggaacagaccaagcccagtgggaagacataacaggaaccaccaaacttgtatatgccaacgagtgcgccaacttcaccaccaatgtctctgccaggttttggctgtcggactgtcctcggactgctgaggctgtgaactttgccaccctgctgtacaaagagctcactgcagtgccctacatggccaaattcgtcatctttgccaagatgaatgacccccgagaggggcgcctgcgctgctactgcatgacagatgataaagtggacaagaccctggagcagcatgagaacttcgtggaggtggcccggagcagggacatagaggtgttggaaggaatgtccctgtttgcagaactctctgggaacctggtgcctgtgaagaaagctgcccagcagcggagcttccacttccagtcatttcgggagaaccgtctggccatgcctgtaaaggtgagggacagcagtcgagagccgggagggtccctgtcgtttctgcgcaaggcgatgaagtacgaggacacccagcacattctctgccacctgaacatcaccatgcccccctgcgccaagggaagtggagccgaagataggagaaggaccccgacgcccctggccctgcgatacagcattctcagtgagtccacaccaggttctctcagtgggacagagcaggcagagatgaagatggctgttatctcagagcacctcggtctcagctgggcagagttggcccgggagctgcagttcagtgtggaagacatcaacaggatccgagtggaaaatcccaactccctgttggagcagagtgtggccttgctgaacctctgggtcatccgtgaaggccaaaacgcaaacatggagaatctgtacacagccctgcagagcattgaccgtggcgagatcgtgaacatgctggagggttccggccgacagagccgcaacttgaagccagacaggcggcacaccgaccgcgactactcgctgtcaccctcccagatgaatggttactcctcactgcaggacgagctgctgtcccctgcctccctgggctgtgcactttcctctccgctacgtgcagaccagtactggaatgaggtggccgtcctagacgccatccccttggcggccacggagcatgacaccatgctggagatgtctgacatgcaggtgtggtctgcgggcctcacgccttctctggtcactgctgaggactcctctctggagtgtagcaaggctgaggactctgatgccacaggtcacgagtggaagttggagggggcactctcagaggaaccgcggggccccgagttgggctctctggaacttgtggaggacgacacagtggattcagatgccacaaatggccttatcgatttgcttgaacaggaggaaggtcagaggtcagaagagaagctgccaggttctaagaggcaggatgacgcgacaggtgcagggcaggactcagagaatgaagtgtctcttgtttcaggccatcagagggggcaagcccgaatcacacattcccccaccgtgagtcaggtgacggagaggagtcaggacagactgcaggactgggatgcagacggctcgattgtctcatacctgcaagatgctgcacaaggttcctggcaagaggaggtcacgcaaggtccacactcattccagggaacaagtaccatgactgaagggctagagcccggtggatctcaggagtacgagaaggtcctggtgtctgtaagtgagcacacgtggacagaacagcccgaggctgagagctcccaggccgacagggaccggaggcagcaaggccaagaagagcaggtgcaggaggccaagaacaccttcacccaagtggtgcaggggaatgagtttcagaatattccaggggagcaggtgacagaggagcaattcacggatgagcagggcaacattgtcaccaagaagatcattcgcaaggtggttcgacagatagacttgtccagcgccgatgccgcccaggagcacgaggaggtggagctgagagggagtggcctacagccggacctgatagagggcaggaagggggcgcagatagtgaagcgggccagcctgaaaagggggaaacagtga

SEQ ID NO: 96 - DNA, 5208 bp, Artificial Sequence
  Description of Artificial Sequence: Synthetic polynucleotide
atgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtggtctgcactacagagcttacacaaggcttgtgaagtcgccagagcgcataactactacccaggcagcctatttctcacttgggtgagttattatgagagccatatcaactcagatcaatcctcagtcaatgaatggaatgcaatgcaagatgtacagtcccaccggcccgactctccagctctcttcaccgacatacctactgaacgtgaacgaacagaaaggctaattaaaaccaaattaagggagatcatgatgcagaaggatttggagaatattacatccaaagagataagaacagagttggaaatgcaaatggtgtgcaacttgcgggaattcaaggaatttatagacaatgaaatgatagtgatccttggtcaaatggatagccctacacagatatttgagcatgtgttcctgggctcagaatggaatgcctccaacttagaggacttacagaaccgaggggtacggtatatcttgaatgtcactcgagagatagataacttcttcccaggagtctttgagtatcataacattcgggtatatgatgaagaggcaacggatctcctggcgtactggaatgacacttacaaattcatctctaaagcaaagaaacatggatctaaatgccttgtgcactgcaaaatgggggtgagtcgctcagcctccaccgtgattgcctatgcaatgaaggaatatggctggaatctggaccgagcctatgactatgtgaaagaaagacgaacggtaaccaagcccaacccaagcttcatgagacaactggaagagtatcaggggatcttgctggcaagcaaacagcggcataacaaactatggagatctcattcagatagtgacctctcagaccaccacgaacccatctgcaaacctgggctagaactcaacaagaaggatatcaccacctcagcagaccagattgctgaggtgaagaccatggagagtcacccacccatacctcctgtctttgtggaacatatggtcccacaagatgcaaatcagaaaggcctgtgtaccaaagaaagaatgatctgcttggagtttacttctagggaatttcatgctggacagattgaggatgaattaaacttaaatgacatcaatggatgctcatcagggtgttgtctgaatgaatcaaaatttcctcttgacaattgccatgcatccaaagccttaattcagcctggacatgtcccagaaatggccaacaagtttccagacttaacagtggaagatttggagacagatgcactgaaagcagacatgaatgtccacctactgcctatggaagaattgacatctccactgaaagacccccccatgtcccctgatcctgagtcaccaagcccccaacccagttgccagactgaaatctcagatttcagtacagatcgcattgacttttttagtgccctagagaagtttgtggagctctcccaagaaacccggtcacgatctttttcccattcaaggatggaggaactgggtggaggaaggaatgagagctgtcgactgtcagtggtagaagtagccccttccaaagtgacagctgatgaccagagaagcagctctttgagtaatactccccatgcatcagaagaatcttcaatggatgaggaacagtcaaaggcaatttcagaactggtcagcccagacatcttcatgcagtctcactcggaaaatgcaatttcagtcaaagaaattgtcactgaaattgagtccatcagtcaaggagttgggcagattcaactgaaaggagacatcttacccaacccatgccatacaccaaagaagaacagcatccatgagctgctccttgagagggcccagactccagagaacaaacctggacatatggagcaagatgaggactcctgcacagcccagcctgaactagccaaagactcagggatgtgcaacccagaaggctgcctaaccacacactcatctatagcagacttggaagaaggggaaccagctgagggggaacaagagctccagggctcagggatgcacccaggtgccaagtggtaccctgggtctgtgaggcgagccaccttggagttcgaagagcgcttacggcaggagcaagagcatcatggtgctgccccaacatgtacctcattgtccactcgtaagaattcaaagaatgattcttctgtggcagacctagcaccaaaagggaaaagtgatgaagcccccccagaacattcatttgtcctcaaggaaccagaaatgagcaaaggcaaagggaaatacagtgggtctgaggctggctcactgtcccattctgagcagaatgccactgttccagctcccagggtgctggagtttgaccacttgccagatcctcaggagggcccagggtcagatactggaacacagcaggaaggagtcctgaaggatctgaggactgtgattccataccaggagtctgaaacacaagcagtccctcttccccttcccaagagggtagaaatcattgaatatacccacatagttacatcacccaatcacactgggccagggagtgaaatagccaccagtgagaagagcggagagcaagggctgaggaaagtgaacatggaaaaatctgtcactgtgctctgcacactggatgaaaatctaaacaggactctggaccccaaccaggtttctctgcacccccaagtgctacctctgcctcattcttcctcccctgagcacaacagacccactgaccatccaacctccatcctgagtagccctgaagacagaggcagcagcctgtccacagccctggagacagcagcaccttttgtcagtcatacaacccatttactgtctgccagtttggattacctgcatccccagactatggttcacctggagggcttcacagagcagagcagcactacagatgagccctctgcagaacaggttagctgggaagaaagtcaggagagccctctctccagtggcagtgaggtgccatataaggactcccagctaagtagcgcagacctaagtttaattagcaaacttggtgacaacactggggagttacaggagaaaatggacccattgcctgtagcctgtcgactcccacatagctctagtagtgaaaacataaagagtctcagccacagccccggtgtggtgaaggagcgtgctaaagaaatcgagtctcgagtggttttccaggcagggctcaccaaaccatcccaaatgaggcgctcagcttctctcgccaaattaggttacttggacctctgtaaagactgcttaccagagagggagcctgcctcctgtgaatcccctcatctcaaactgcttcagcctttcctcagaacagactcaggcatgcacgcgatggaggaccaagagtccctagaaaacccaggtgccccccacaacccagagcccaccaagtcttttgtagaacaactcacaacaacagagtgtattgtgcagagcaagccagtggagaggccccttgtgcagtatgccaaagaatttggttctagtcagcagtatttgctccccagggcaggacttgaattgactagttctgaaggaggccttcccgtgctacagacccagggactgcagtgtgcatgcccagctccagggctggccgtggcaccccgtcagcaacacggcagaactcacccccttaggagactgaaaaaggcaaatgacaaaaaacggacaaccaaccccttctataataccatgtga

SEQ ID NO: 97 - DNA, 2306 bp, Artificial Sequence
  Description of Artificial Sequence: Synthetic polynucleotide
atggagggggtgctgtacaagtggaccaactatctgagcggttggcagcctcgatggttccttctctgtgggggaatattgtcctattatgattctcctgaagatgcctggaaaggttgcaaagggagcatacaaatggcagtctgtgaaattcaagttcattctgtagataatacacgcatggacctgataatccctggggaacagtatttctacctgaaggccagaagtgtggctgaaagacagcggtggctggtggccctgggatcagccaaggcttgcctgactgacagtaggacccagaaggagaaagagtttgctgaaaacactgaaaacttgaaaaccaaaatgtcagaactaagactctactgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagatcgcaaatgcagccttcacctctgagctgctctaccgcactccaccaggatcacctcagctggccatgctcaagtccagcaagatgaaacatcctattataccaattcataattcattggaaaggcaaatggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataacagtccaaggtgaaataaggaaggaagatggaatggaaaacctgaaaaatcatgacaataacttgactcagtctggatcagactcaagttgctctccggaatgcctctgggaggaaggcaaagaagttatcccaactttctttagtaccatgaacacaagctttagtgacattgaacttctggaagacagtggcattcccacagaagcattcttggcatcatgttatgctgtggttccagtattagacaaacttggccctacagtgtttgctcctgttaagatggatcttgttggaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggagaaggatatccagacagccctaaataatgcatatggtaaaacattgcggcaacaccatggctgggtagttcgaggggtttttgcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaa

SEQ ID NO: 98 - DNA, 1888 bp, Artificial Sequence
  Description of Artificial Sequence: Synthetic polynucleotide
atgaggagggacgtgaacggagtgaccaagagcaggtttgagatgttctcaaatagtgatgaagctgtaatcaataaaaaacttcccaaagaactcctgttacggatattttcttttctagatgttgttaccctgtgccgctgtgctcaggtctccagggcctggaatgttctggctctggatggcagtaactggcagcgaattgacctatttgatttccagagggatattgagggccgagtagtggagaatatttcaaaacgatgtgggggctttttacgaaagttaagtcttcgtggatgtcttggagtgggagacaatgcattaagaacctttgcacaaaactgcaggaacattgaagtactgaatctaaatgggtgtacaaagacaacagacgcgttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattga

SEQ ID NO: 99 - DNA, 4914 bp, Artificial Sequence
  Description of Artificial Sequence: Synthetic polynucleotide
atggatgaacagagcgtggagagcattgctgaggttttccgatgtttcatttgtatggagaaattgcgggatgcacgcctgtgtcctcattgctccaaactgtgttgtttcagctgtattaggcgctggctgacagagcagagagctcaatgtcctcattgccgtgctccactccagctacgagaactagtaaattgtcgttgggcagaagaagtaacacaacagcttgatactcttcaactctgcagtctcaccaaacatgaagaaaatgaaaaggacaaatgtgaaaatcaccatgaaaaacttagtgtattttgctggacttgtaagaagtgtatctgccatcagtgtgcactttggggaggaatgcatggcggacatacctttaaacctttggcagaaatttatgagcaacacgtcactaaagtgaatgaagaggtagccaaacttcgtcggcgtctcatggaactgatcagcttagttcaagaagtggaaaggaatgtagaagctgtaagaaatgcaaaagatgagcgtgttcgggaaattaggaatgcagtggagatgatgattgcacggttagacacacagctgaagaataagcttataacactgatgggtcagaagacatctctaacccaagaaacagagcttttggaatccttacttcaggaggtggagcaccagttgcggtcttgtagtaagagtgagttgatatctaagagctcagagatccttatgatgtttcagcaagttcatcggaagcccatggcatcttttgttaccactcctgttccaccagactttaccagtgaattagtgccatcttacgattcagctacttttgttttagagaatttcagcactttgcgtcagagagcagatcctgtttacagtccacctcttcaagtttcaggactttgctggaggttaaaagtttacccagatggaaatggagttgtgcgaggttactacttatctgtgtttctggagctctcagctggcttgcctgaaacttctaaatatgaatatcgtgtagagatggttcaccagtcctgtaatgatcctacaaaaaatatcattcgagaatttgcatctgactttgaagttggagaatgctggggctataatagatttttccgtttggacttactcgcaaatgaaggatacttgaatccacaaaatgatacagtgattttaaggtttcaggtacgttcaccaactttctttcaaaaatcccgggaccagcattggtacattactcagttggaagctgcacagactagttatatccaacaaataaacaaccttaaagagagacttactattgagctgtctcgaactcagaagtcaagagatttgtcaccaccagataaccatcttagcccccaaaatgatgatgctctggagacacgagctaagaagtctgcatgctctgacatgcttctcgaaggtggtcctactacagcttctgtaagagaggccaaagaggatgaagaagatgaggagaagattcagaatgaagattatcatcacgagctttcagatggagatctggatctggatcttgtttatgaggatgaagtaaatcagctcgatggcagcagttcctctgctagttccacagcaacaagtaatacagaagaaaatgatattgatgaagaaactatgtctggagaaaatgatgtggaatataacaacatggaattagaagagggagaactcatggaagatgcagctgctgcaggacccgcaggtagtagccatggttatgtgggttccagtagtagaatatcaagaagaacacatttatgctccgctgctaccagtagtttactagacattgatccattaattttaatacatttgttggaccttaaggaccggagcagtatagaaaatttgtggggcttacagcctcgcccacctgcttcacttctgcagcccacagcatcatattctcgaaaagataaagaccaaaggaagcaacaggcaatgtggcgagtgccctctgatttaaagatgctaaaaagactcaaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactccacaaataagaagagtaattcgcccaagccagctcgatccagtgtagcaggtagtctatcacttcgaagagcagtggaccctggagaaaatagtcgttcaaagggagactgtcagactctgtctgaagatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtag

SEQ ID NO: 100 - DNA, 1534 bp, Artificial Sequence
  Description of Artificial Sequence: Synthetic polynucleotide
atgaacaaccgaaaggaagatatggaaatcacgtcccactaccggcacctgctgcgggagctcaacgagcagaggcagcacggcgtcctgtgcgacgtctgcgtggtcgtggagggcaaggtcttcaaggcgcacaagaacgtcctgctgggcagcagccgctacttcaagacgctctactgccaggtgcagaagacgtcggagcaggccacggtcacgcacctggacatcgtcacggcccagggcttcaaggccatcatcgacttcatgtactcagcgcacctggcgctcaccagcaggaacgtcatcgaggtgatgtcagccgccagcttcctgcagatgacggacatcgtgcaagcctgccacgacttcatcaaggcggcgctggacatcagcatcaagtcggacgcctcagatgagcttgcggagttcgagatcggcgcctcgtccagcagcagcacggaagctctcatctcggccgtgatggctgggaggagcatctccccgtggctggcacggcgaacgagtcctgccaattcttccggagactcggccatcgccagctgtcacgacggagggagcagctacgggaaagaggatcaggagcccaaggccgatggccctgatgatgtttcttcacagcctctatggcctggagacgtgggctacgggcctctgcgcatcaaggaagagcaggtttcaccgtctcagtacggagggagcgagctgccttctgccaaggacggtgcagtacagaactctttctcagagcagagtgctggtgatgcctggcagcccacgggccgaaggaagaatcggaaaaacaaagagaccgtccggcacatcacacagcaggtggaagatgacagccgggccagctccccggtgccgtccttcctgccgacgtcggggtggccgttcagcagccgagactcaaatggcagaccagagacagcgctcactgtctacctctggggagtcattgtaccacgtccttgggttggacaagaacgcaacctcagatgacattaaaaagtcctatcggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagagggaggccacagacacgccgatcgtcatacagccggcatccgccaccgagaccacccagctcacagccgactcccaccccagctaccacactgacgggttcaactaa

SEQ ID NO: 101 - DNA, 22 bp, Artificial Sequence
  Description of Artificial Sequence: Synthetic primer
gcagactactgtgaaaacaact

SEQ ID NO: 102 - DNA, 30 bp, Artificial Sequence
  Description of Artificial Sequence: Synthetic probe
acatacaggtctctgttctaggatgtcccg

SEQ ID NO: 103 - DNA, 19 bp, Artificial Sequence
  Description of Artificial Sequence: Synthetic primer
ttccgtactgataggcgat

SEQ ID NO: 104 - DNA, 88 bp, Artificial Sequence
  Description of Artificial Sequence: Synthetic oligonucleotide
gcagactactgtgaaaacaactacatacaggtctctgttctaggatgtcccgacccagtggtgcatgagatcgcctatcagtacggaa

SEQ ID NO: 105 - DNA, 19 bp, Artificial Sequence
  Description of Artificial Sequence: Synthetic primer
tccacatgaacaggcttcc

SEQ ID NO: 106 - DNA, 28 bp, Artificial Sequence
  Description of Artificial Sequence: Synthetic probe
ttgttcttgtgaccatctcatttcctcc

SEQ ID NO: 107 - DNA, 19 bp, Artificial Sequence
  Description of Artificial Sequence: Synthetic primer
gcagataacccgcctacaa

SEQ ID NO: 108 - DNA, 76 bp, Artificial Sequence
  Description of Artificial Sequence: Synthetic oligonucleotide
tccacatgaacaggcttccaggaggaaatgagatggtcacaagaacaaagaaaatatttgtaggcgggttatctgc

SEQ ID NO: 109 - DNA, 20 bp, Artificial Sequence
  Description of Artificial Sequence: Synthetic primer
tgaccaaatcttggctgaag

SEQ ID NO: 110 - DNA, 27 bp, Artificial Sequence
  Description of Artificial Sequence: Synthetic probe
cagtccttccagtgacagttccttgtg

SEQ ID NO: 111 - DNA, 18 bp, Artificial Sequence
  Description of Artificial Sequence: Synthetic primer
ctccaggctcctgaatgc

SEQ ID NO: 112 - DNA, 73 bp, Artificial Sequence
  Description of Artificial Sequence: Synthetic oligonucleotide
tgaccaaatcttggctgaagacaaacacaaggaactgtcactggaaggactgagcgcattcaggagcctggag

SEQ ID NO: 113 - DNA, 21 bp, Artificial Sequence
  Description of Artificial Sequence: Synthetic primer
ggacttcgatgatgaagatgg

SEQ ID NO: 114 - DNA, 29 bp, Artificial Sequence
  Description of Artificial Sequence: Synthetic probe
tctttcttgaaaatttactggggccttca

SEQ ID NO: 115 - DNA, 21 bp, Artificial Sequence
  Description of Artificial Sequence: Synthetic primer
tgtgctctggaagatctcctt

SEQ ID NO: 116 - DNA, 85 bp, Artificial Sequence
  Description of Artificial Sequence: Synthetic oligonucleotide
ggacttcgatgatgaagatggtgaaggccccagtaaattttcaagaaagatgatgacattgaagaaggagatcttccagagcaca

SEQ ID NO: 117 - DNA, 20 bp, Artificial Sequence
  Description of Artificial Sequence: Synthetic primer
aaacgtattgctgagaggga

SEQ ID NO: 118 - DNA, 34 bp, Artificial Sequence
  Description of Artificial Sequence: Synthetic probe
accatttacctctctcaatttttctcgctcacgc

SEQ ID NO: 119 - DNA, 24 bp, Artificial Sequence
  Description of Artificial Sequence: Synthetic primer
ccattggctcatcaaccattttaa

SEQ ID NO: 120 - DNA, 79 bp, Artificial Sequence
  Description of Artificial Sequence: Synthetic oligonucleotide
aaacgtattgctgagagggagcgtgagcgagaaaaattgagagaggtaaatggtcttaaaatggttgatgagccaatgg

SEQ ID NO: 121 - DNA, 19 bp, Artificial Sequence
  Description of Artificial Sequence: Synthetic primer
aacagttcctccccaggga

SEQ ID NO: 122 - DNA, 31 bp, Artificial Sequence
  Description of Artificial Sequence: Synthetic probe
ttgacaagttcaactcccatgcatgtccatc

SEQ ID NO: 123 - DNA, 28 bp, Artificial Sequence
  Description of Artificial Sequence: Synthetic primer
cctttgtttcatacatatcactgtagac

SEQ ID NO: 124 - DNA, 85 bp, Artificial Sequence
  Description of Artificial Sequence: Synthetic oligonucleotide
aacagttcctccccagggatgatggacatgcatgggagttgaacttgtcaaattaatgtctacagtgatatgtatgaaacaaagg

SEQ ID NO: 125 - DNA, 18 bp, Artificial Sequence
  Description of Artificial Sequence: Synthetic primer
cctgcgccgcgacaagta

SEQ ID NO: 126 - DNA, 30 bp, Artificial Sequence
  Description of Artificial Sequence: Synthetic probe
cctcaaacaccccactcgaggaactcggcc

SEQ ID NO: 127 - DNA, 22 bp, Artificial Sequence
  Description of Artificial Sequence: Synthetic primer
tcttgccttccctcttccacag

SEQ ID NO: 128 - DNA, 75 bp, Artificial Sequence
  Description of Artificial Sequence: Synthetic oligonucleotide
cctgcgccgcgacaagtacgtggccgagttcctcgagtggggtgtttgaggaactgtggaagagggaaggcaaga

SEQ ID NO: 129 - DNA, 18 bp, Artificial Sequence
  Description of Artificial Sequence: Synthetic primer
ctgactcgggaggaggac

SEQ ID NO: 130 - DNA, 28 bp, Artificial Sequence
  Description of Artificial Sequence: Synthetic probe
tgtcagatccaggacatcatcagtcttg

SEQ ID NO: 131 - DNA, 24 bp, Artificial Sequence
  Description of Artificial Sequence: Synthetic primer
gataggttggtacatggtgatttt

SEQ ID NO: 132 - DNA, 76 bp, Artificial Sequence
  Description of Artificial Sequence: Synthetic oligonucleotide
ctgactcgggaggaggacctgatcaagactgatgatgtcctggatctgacaaaaaatcaccatgtaccaacctatc

SEQ ID NO: 133 - DNA, 19 bp, Artificial Sequence
  Description of Artificial Sequence: Synthetic primer
acatggggaccacagtcaa

SEQ ID NO: 134 - DNA, 24 bp, Artificial Sequence
  Description of Artificial Sequence: Synthetic probe
ctgggcacctgaaacacatctcca

SEQ ID NO: 135 - DNA, 20 bp, Artificial Sequence
  Description of Artificial Sequence: Synthetic primer
agggtcattgtcctggtctt

SEQ ID NO: 136 - DNA, 82 bp, Artificial Sequence
  Description of Artificial Sequence: Synthetic oligonucleotide
acatggggaccacagtcaatggagatgtgtttcaggtgcccaggccttctggttggtagcggaagaccaggacaatgaccct

SEQ ID NO: 137 - DNA, 23 bp, Artificial Sequence
  Description of Artificial Sequence: Synthetic primer
ggtgccaactccaatttaccaaa

SEQ ID NO: 138 - DNA, 30 bp, Artificial Sequence
  Description of Artificial Sequence: Synthetic probe
actgaacgaatgtatactgtccactgctag

SEQ ID NO: 139 - DNA, 24 bp, Artificial Sequence
  Description of Artificial Sequence: Synthetic primer
gcagtacttctattatgctctctg

SEQ ID NO: 140 - DNA, 77 bp, Artificial Sequence
  Description of Artificial Sequence: Synthetic oligonucleotide
ggtgccaactccaatttaccaaactagcagtggacagtatacattcgttcagtcagagagcataatagaagtactgc

SEQ ID NO: 141 - DNA, 20 bp, Artificial Sequence
  Description of Artificial Sequence: Synthetic primer
cccaagttgcttcagttggt

SEQ ID NO: 142 - DNA, 22 bp, Artificial Sequence
  Description of Artificial Sequence: Synthetic probe
cgaagacagaggttcagagtca

SEQ ID NO: 143 - DNA, 20 bp, Artificial Sequence
  Description of Artificial Sequence: Synthetic primer
ttgcagttggtccttgaggt

SEQ ID NO: 144 - DNA, 79 bp, Artificial Sequence
  Description of Artificial Sequence: Synthetic oligonucleotide
cccaagttgcttcagttggtcgaagacagaggttcagagtcagaatgagtatattgctaacctcaaggaccaactgcaa

SEQ ID NO: 145 - DNA, 20 bp, Artificial Sequence
  Description of Artificial Sequence: Synthetic primer
accagaaggagatcggtgac

SEQ ID NO: 146 - DNA, 23 bp, Artificial Sequence
  Description of Artificial Sequence: Synthetic probe
aatcatccactgctgctgctggg

SEQ ID NO: 147 - DNA, 19 bp, Artificial Sequence
  Description of Artificial Sequence: Synthetic primer
ctgctttgtgtggctgttg

SEQ ID NO: 148 - DNA, 69 bp, Artificial Sequence
  Description of Artificial Sequence: Synthetic oligonucleotide
accagaaggagatcggtgacctccgtgcccagcagcagcagtggatgattcaacagccacacaaagcag

SEQ ID NO: 149 - DNA, 15 bp, Artificial Sequence
  Description of Artificial Sequence: Synthetic primer
tgcctgccgcgccga

SEQ ID NO: 150 - DNA, 25 bp, Artificial Sequence
  Description of Artificial Sequence: Synthetic probe
aatcggaactcctgctttccgccgc

SEQ ID NO: 151 - DNA, 21 bp, Artificial Sequence
  Description of Artificial Sequence: Synthetic primer
cggggtctcaaatgcctcttc

SEQ ID NO: 152 - DNA, 74 bp, Artificial Sequence
  Description of Artificial Sequence: Synthetic oligonucleotide
tgcctgccgcgccgagggaccgccgggcggcggaaagcaggagttccgattctgaagaggcatttgagaccccg

SEQ ID NO: 153 - DNA, 23 bp, Artificial Sequence
  Description of Artificial Sequence: Synthetic primer
cctacagcttattatcgtcatcc

SEQ ID NO: 154 - DNA, 32 bp, Artificial Sequence
  Description of Artificial Sequence: Synthetic probe
aggaattatcatacactggtgtcttccccggc

SEQ ID NO: 155 - DNA, 22 bp, Artificial Sequence
  Description of Artificial Sequence: Synthetic primer
gttttccccataaggttgttgg

SEQ ID NO: 156 - DNA, 79 bp, Artificial Sequence
  Description of Artificial Sequence: Synthetic oligonucleotide
cctacagcttattatcgtcatcctgccggggaagacaccagtgtatgataattcctaccaacaaccttatggggaaaac

SEQ ID NO: 157 - DNA, 18 bp, Artificial Sequence
  Description of Artificial Sequence: Synthetic primer
acgttcgacaccatgggc

SEQ ID NO: 158 - DNA, 26 bp, Artificial Sequence
  Description of Artificial Sequence: Synthetic probe
tcgttcctcgtaagcgtagatgcccc

SEQ ID NO: 159 - DNA, 18 bp, Artificial Sequence
  Description of Artificial Sequence: Synthetic primer
caccaccgtcagcaggta

SEQ ID NO: 160 - DNA, 82 bp, Artificial Sequence
  Description of Artificial Sequence: Synthetic oligonucleotide
acgttcgacaccatgggcctgcgggaggacctgctgcggggcatctacgcttacgaggaacgagtacctgctgacggtggtg

SEQ ID NO: 161 - DNA, 18 bp, Artificial Sequence
  Description of Artificial Sequence: Synthetic primer
tttgggagcctggcattt

SEQ ID NO: 162 - DNA, 29 bp, Artificial Sequence
  Description of Artificial Sequence: Synthetic probe
cattgaatcatccatcaaagctctccggc

SEQ ID NO: 163 - DNA, 24 bp, Artificial Sequence
  Description of Artificial Sequence: Synthetic primer
tctttcactgtattcatctttcac

SEQ ID NO: 164 - DNA, 76 bp, Artificial Sequence
  Description of Artificial Sequence: Synthetic oligonucleotide
tttgggagcctggcatttctgccggagagctttgatggatgattcaatgaaagtgaaagatgaatacagtgaaaga

SEQ ID NO: 165 - DNA, 20 bp, Artificial Sequence
  Description of Artificial Sequence: Synthetic primer
gctccgcaaatgctacgaag

SEQ ID NO: 166 - DNA, 32 bp, Artificial Sequence
  Description of Artificial Sequence: Synthetic probe
agtctctctgtccaacacctttcatcattccc

SEQ ID NO: 167 - DNA, 24 bp, Artificial Sequence
  Description of Artificial Sequence: Synthetic primer
gagtctcttttgctcacatcttca

SEQ ID NO: 168 - DNA, 78 bp, Artificial Sequence
  Description of Artificial Sequence: Synthetic oligonucleotide
gctccgcaaatgctacgaagtgggaatgatgaaaggtgttggacagagagactctgaagatgtgagcaaaagagactc

SEQ ID NO: 169 - DNA, 20 bp, Artificial Sequence
  Description of Artificial Sequence: Synthetic primer
atgatcaactgggcgaagag

SEQ ID NO: 170 - DNA, 20 bp, Artificial Sequence
  Description of Artificial Sequence: Synthetic probe
ggtgccagttggacagagag

SEQ ID NO: 171 - DNA, 20 bp, Artificial Sequence
  Description of Artificial Sequence: Synthetic primer
cggagtctcttttgctcaca

SEQ ID NO: 172 - DNA, 70 bp, Artificial Sequence
  Description of Artificial Sequence: Synthetic oligonucleotide
atgatcaactgggcgaagagggtgccagttggacagagagactctgaagatgtgagcaaaagagactccg

SEQ ID NO: 173 - DNA, 18 bp, Artificial Sequence
  Description of Artificial Sequence: Synthetic primer
acctggagaacgagccca

SEQ ID NO: 174 - DNA, 22 bp, Artificial Sequence
  Description of Artificial Sequence: Synthetic probe
cgccggcattctacagtccacc

SEQ ID NO: 175 - DNA, 23 bp, Artificial Sequence
  Description of Artificial Sequence: Synthetic primer
cctgtgacccatagaaattttgc

SEQ ID NO: 176 - DNA, 126 bp, Artificial Sequence
  Description of Artificial Sequence: Synthetic polynucleotide
acctggagaacgagcccagcggctacacggtgcgcgaggccggcccgccggcattctacagtccaccaatcgattactttgatgtatttaaagaatcaaaagagcaaaatttctatgggtcacagg

SEQ ID NO: 177 - DNA, 15 bp, Artificial Sequence
  Description of Artificial Sequence: Synthetic primer
tacacggtgcgcgag

SEQ ID NO: 178 - DNA, 26 bp, Artificial Sequence
  Description of Artificial Sequence: Synthetic probe
ccggcattctacagtccaccaatcga

SEQ ID NO: 179 - DNA, 31 bp, Artificial Sequence
  Description of Artificial Sequence: Synthetic primer
gctcttttgattctttaaatacatcaaagta

SEQ ID NO: 180 - DNA, 82 bp, Artificial Sequence
  Description of Artificial Sequence: Synthetic oligonucleotide
tacacggtgcgcgaggccggcccgccggcattctacagtccaccaatcgattactttgatgtatttaaagaatcaaaagagc

SEQ ID NO: 181 - DNA, 18 bp, Artificial Sequence
  Description of Artificial Sequence: Synthetic primer
agctcctccgttcgacag

SEQ ID NO: 182 - DNA, 23 bp, Artificial Sequence
  Description of Artificial Sequence: Synthetic probe
atagcaacatctctcgcccggct

SEQ ID NO: 183 - DNA, 23 bp, Artificial Sequence
  Description of Artificial Sequence: Synthetic primer
tcatttttgatgaatctgtcctc

SEQ ID NO: 184 - DNA, 80 bp, Artificial Sequence
  Description of Artificial Sequence: Synthetic oligonucleotide
agctcctccgttcgacaggcgggggaagaggccgagccgggcgagagatgttgctatgaggacagattcatcaaaaatga

SEQ ID NO: 185 - DNA, 24 bp, Artificial Sequence
  Description of Artificial Sequence: Synthetic primer
ggaacattgaagtactgaatctaa

SEQ ID NO: 186 - DNA, 31 bp, Artificial Sequence
  Description of Artificial Sequence: Synthetic probe
tttacaacgcgtctgttgtctttgtacaccc

SEQ ID NO: 187 - DNA, 24 bp, Artificial Sequence
  Description of Artificial Sequence: Synthetic primer
tccatataacaggatgcctttaac

SEQ ID NO: 188 - DNA, 84 bp, Artificial Sequence
  Description of Artificial Sequence: Synthetic oligonucleotide
ggaacattgaagtactgaatctaaatgggtgtacaaagacaacagacgcgttgtaaacatgttaaaggcatcctgttatatgga

SEQ ID NO: 189 - DNA, 23 bp, Artificial Sequence
  Description of Artificial Sequence: Synthetic primer
tcctccccattctatacaaaaac

SEQ ID NO: 190 - DNA, 29 bp, Artificial Sequence
  Description of Artificial Sequence: Synthetic probe
agttttccccctacttcgaggtttttgtt

SEQ ID NO: 191 - DNA, 20 bp, Artificial Sequence
  Description of Artificial Sequence: Synthetic primer
ctgtcctcatcttccactgc

SEQ ID NO: 192 - DNA, 72 bp, Artificial Sequence
  Description of Artificial Sequence: Synthetic oligonucleotide
tcctccccattctatacaaaaacaacaaaaacctcgaagtagggggaaaactgcagtggaagatgaggacag

SEQ ID NO: 193 - DNA, 16 bp, Artificial Sequence
  Description of Artificial Sequence: Synthetic primer
tcctgcagcgggcggc

SEQ ID NO: 194 - DNA, 31 bp, Artificial Sequence
  Description of Artificial Sequence: Synthetic probe
attcttgaatcggagcctgggcaggaggctg

SEQ ID NO: 195 - DNA, 24 bp, Artificial Sequence
  Description of Artificial Sequence: Synthetic primer
ctgatattgctctctgggtttggc

SEQ ID NO: 196 - DNA, 92 bp, Artificial Sequence
  Description of Artificial Sequence: Synthetic oligonucleotide
tcctgcagcgggcggccccctgcagcctcctgcccaggctccgattcaagaatggctttgtttaaattgccaaacccagagagcaatatcag

SEQ ID NO: 197 - DNA, 20 bp, Artificial Sequence
  Description of Artificial Sequence: Synthetic primer
ttggtctgtggagtgcctga

SEQ ID NO: 198 - DNA, 35 bp, Artificial Sequence
  Description of Artificial Sequence: Synthetic probe
tggcacactacaaagttgaccttacaaaaagctgg

SEQ ID NO: 199 - DNA, 19 bp, Artificial Sequence
  Description of Artificial Sequence: Synthetic primer
ctgctagcaaggcaaagag

SEQ ID NO: 200 - DNA, 80 bp, Artificial Sequence
  Description of Artificial Sequence: Synthetic oligonucleotide
ttggtctgtggagtgcctgaagtgaccagctttttgtaaggtcaactttgtagtgtgccaactctttgccttgctagcag

SEQ ID NO: 201 - DNA, 18 bp, Artificial Sequence
  Description of Artificial Sequence: Synthetic primer
tgggcagtgtgccagggt

SEQ ID NO: 202 - DNA, 30 bp, Artificial Sequence
  Description of Artificial Sequence: Synthetic probe
ccttgcggcctcctcaaggttttgaacgaa

SEQ ID NO: 203 - DNA, 24 bp, Artificial Sequence
  Description of Artificial Sequence: Synthetic primer
ctgccttgtaccagttctgatcac

SEQ ID NO: 204 - DNA, 77 bp, Artificial Sequence
  Description of Artificial Sequence: Synthetic oligonucleotide
tgggcagtgtgccagggtcccttgcggcctcctcaaggttttgaacgaagaatgtgatcagaactggtacaaggcag

SEQ ID NO: 205 - DNA, 20 bp, Artificial Sequence
  Description of Artificial Sequence: Synthetic primer
aaaaccttcgcctcatccta

SEQ ID NO: 206 - DNA, 27 bp, Artificial Sequence
  Description of Artificial Sequence: Synthetic probe
tgaaaacccttctagctgctcctctcc

SEQ ID NO: 207 - DNA, 18 bp, Artificial Sequence
  Description of Artificial Sequence: Synthetic primer
aagcgcagtgctgtgaaa

SEQ ID NO: 208 - DNA, 74 bp, Artificial Sequence
  Description of Artificial Sequence: Synthetic oligonucleotide
aaaaccttcgcctcatcctaggagaggagcagctagaagggttttcaaattaaagctttcacagcactgcgctt

SEQ ID NO: 209 - DNA, 18 bp, Artificial Sequence
  Description of Artificial Sequence: Synthetic primer
tgagcgatggcatcggtc

SEQ ID NO: 210 - DNA, 28 bp, Artificial Sequence
  Description of Artificial Sequence: Synthetic probe
tccggcccatgaatcgcagcttcccttt

SEQ ID NO: 211 - DNA, 19 bp, Artificial Sequence
  Description of Artificial Sequence: Synthetic primer
agtggtacagaccttcagc

SEQ ID NO: 212 - DNA, 81 bp, Artificial Sequence
  Description of Artificial Sequence: Synthetic oligonucleotide
tgagcgatggcatcggtcaaggtggccgtgagggtccggcccatgaatcgcagcttccctttgctgaaggtctgtaccact

SEQ ID NO: 213 - DNA, 20 bp, Artificial Sequence
  Description of Artificial Sequence: Synthetic primer
gctgctggcgctgtgcggct

SEQ ID NO: 214 - DNA, 29 bp, Artificial Sequence
  Description of Artificial Sequence: Synthetic probe
cccggcccccgccgcgggattctttctac

SEQ ID NO: 215 - DNA, 27 bp, Artificial Sequence
  Description of Artificial Sequence: Synthetic primer
ccccaagaaactagtcagcacttcaac

SEQ ID NO: 216 - DNA, 91 bp, Artificial Sequence
  Description of Artificial Sequence: Synthetic oligonucleotide
gctgctggcgctgtgcggctgcccggcccccgccgcgggattctttctactaatccagatacttgttgaagtgctgactagtttcttgggg

SEQ ID NO: 217 - DNA, 18 bp, Artificial Sequence
  Description of Artificial Sequence: Synthetic primer
caacggcaggacgtgtaa

SEQ ID NO: 218 - DNA, 24 bp, Artificial Sequence
  Description of Artificial Sequence: Synthetic probe
tcatggtggatctcacaagctgcc

SEQ ID NO: 219 - DNA, 20 bp, Artificial Sequence
  Description of Artificial Sequence: Synthetic primer
ggactgcatccaactccttc

SEQ ID NO: 220 - DNA, 63 bp, Artificial Sequence
  Description of Artificial Sequence: Synthetic oligonucleotide
caacggcaggacgtgtaaggcagcttgtgagatccaccatgaagaaggagttggatgcagtcc

SEQ ID NO: 221 - DNA, 18 bp, Artificial Sequence
  Description of Artificial Sequence: Synthetic primer
agaaggactgcgagggtg

SEQ ID NO: 222 - DNA, 28 bp, Artificial Sequence
  Description of Artificial Sequence: Synthetic probe
ccggctgtgctacctgctatattcccaa

SEQ ID NO: 223 - DNA, 24 bp, Artificial Sequence
  Description of Artificial Sequence: Synthetic primer
ggttcatagcagtgctaatccaag

SEQ ID NO: 224 - DNA, 84 bp, Artificial Sequence
  Description of Artificial Sequence: Synthetic oligonucleotide
agaaggactgcgagggtggagcggatgaggccggctgtgctacctgctatattcccaaagcttggattagcactgctatgaacc

SEQ ID NO: 225 - DNA, 18 bp, Artificial Sequence
  Description of Artificial Sequence: Synthetic primer
agaagcgcagcaacgtgc

SEQ ID NO: 226 - DNA, 30 bp, Artificial Sequence
  Description of Artificial Sequence: Synthetic probe
tgggaccacgagagctgtcctctacaagcc

SEQ ID NO: 227 - DNA, 18 bp, Artificial Sequence
  Description of Artificial Sequence: Synthetic primer
gtggtgtgtgggcatcac

SEQ ID NO: 228 - DNA, 70 bp, Artificial Sequence
  Description of Artificial Sequence: Synthetic oligonucleotide
agaagcgcagcaacgtgcggtgggaccacgagagctgtcctctacaagcctggtgatgcccacacaccac

SEQ ID NO: 229 - DNA, 20 bp, Artificial Sequence
  Description of Artificial Sequence: Synthetic primer
ctggagccaatcagcgcggg

SEQ ID NO: 230 - DNA, 30 bp, Artificial Sequence
  Description of Artificial Sequence: Synthetic probe
tgaccgttccgtgcctcgctcccccggttc

SEQ ID NO: 231 - DNA, 26 bp, Artificial Sequence
  Description of Artificial Sequence: Synthetic primer
ctcttcattgtagcttgatcctgcgc

SEQ ID NO: 232 - DNA, 82 bp, Artificial Sequence
  Description of Artificial Sequence: Synthetic oligonucleotide
ctggagccaatcagcgcgggcagcgaaccgggggagcgaggcacggaacggtcactgcgcaggatcaagctacaatgaagag

SEQ ID NO: 233 - DNA, 22 bp, Artificial Sequence
  Description of Artificial Sequence: Synthetic primer
catgatgtagatcatcctggtg

SEQ ID NO: 234 - DNA, 34 bp, Artificial Sequence
  Description of Artificial Sequence: Synthetic probe
tgtccaatcaatttctgatcaatacaagacaagc

SEQ ID NO: 235 - DNA, 21 bp, Artificial Sequence
  Description of Artificial Sequence: Synthetic primer
ctcacagagtcctgaaagtca

SEQ ID NO: 236 - DNA, 78 bp, Artificial Sequence
  Description of Artificial Sequence: Synthetic oligonucleotide
catgatgtagatcatcctggtgtgtccaatcaatttctgatcaatacaagacaagcatgactttcaggactctgtgag

SEQ ID NO: 237 - DNA, 18 bp, Artificial Sequence
  Description of Artificial Sequence: Synthetic primer
cccccatgtaccacacct

SEQ ID NO: 238 - DNA, 24 bp, Artificial Sequence
  Description of Artificial Sequence: Synthetic probe
tgatgtcaaacatttcccaggcga

SEQ ID NO: 239 - DNA, 20 bp, Artificial Sequence
  Description of Artificial Sequence: Synthetic primer
cctccaattggttctcatcc

SEQ ID NO: 240 - DNA, 75 bp, Artificial Sequence
  Description of Artificial Sequence: Synthetic oligonucleotide
cccccatgtaccacacctgtgtggccttcgcctgggaaatgtttgacatcatcctggatgagaaccaattggagg

SEQ ID NO: 241 - DNA, 20 bp, Artificial Sequence
  Description of Artificial Sequence: Synthetic primer
caggcacctggataaccttt

SEQ ID NO: 242 - DNA, 26 bp, Artificial Sequence
  Description of Artificial Sequence: Synthetic probe
aaaaacagccaaaccaaacaggaagc

SEQ ID NO: 243 - DNA, 23 bp, Artificial Sequence
  Description of Artificial Sequence: Synthetic primer
tgacatcattggctaggtagaga

SEQ ID NO: 244 - DNA, 83 bp, Artificial Sequence
  Description of Artificial Sequence: Synthetic oligonucleotide
caggcacctggataaccttttgctaacaaaaacagccaaaccaaacaggaagcttacttttctctacctagccaatgatgtca

SEQ ID NO: 245 - DNA, 25 bp, Artificial Sequence
  Description of Artificial Sequence: Synthetic primer
gtactgagcctgttggaggaactgg

SEQ ID NO: 246 - DNA, 24 bp, Artificial Sequence
  Description of Artificial Sequence: Synthetic probe
ccctgggcgtcctcctgtttccgg

SEQ ID NO: 247 - DNA, 18 bp, Artificial Sequence
  Description of Artificial Sequence: Synthetic primer
agcggggctgggcactgg

SEQ ID NO: 248 - DNA, 74 bp, Artificial Sequence
  Description of Artificial Sequence: Synthetic oligonucleotide
gtactgagcctgttggaggaactggcccggaaacaggaggacgcccagggccccggccagtgcccagccccgct

SEQ ID NO: 249 - DNA, 20 bp, Artificial Sequence
  Description of Artificial Sequence: Synthetic primer
aacagctgggaaccttcact

SEQ ID NO: 250 - DNA, 24 bp, Artificial Sequence
  Description of Artificial Sequence: Synthetic probe
cagagtacgtgcactgcctgctga

SEQ ID NO: 251 - DNA, 18 bp, Artificial Sequence
  Description of Artificial Sequence: Synthetic primer
atgcagcccattgctctc

SEQ ID NO: 252 - DNA, 84 bp, Artificial Sequence
  Description of Artificial Sequence: Synthetic oligonucleotide
aacagctgggaaccttcactaccctggtgggaggcccagagtacgtgcactgcctgctgagcgccagagagcaatgggctgcat

SEQ ID NO: 253 - DNA, 23 bp, Artificial Sequence
  Description of Artificial Sequence: Synthetic primer
aaccttcactaccctggtgggag

SEQ ID NO: 254 - DNA, 35 bp, Artificial Sequence
  Description of Artificial Sequence: Synthetic probe
attgctctctggcgctcagcaggcagtgcacgtac

SEQ ID NO: 255 - DNA, 22 bp, Artificial Sequence
  Description of Artificial Sequence: Synthetic primer
gtcttgccaccaacgatgcagc

SEQ ID NO: 256 - DNA, 89 bp, Artificial Sequence
  Description of Artificial Sequence: Synthetic oligonucleotide
aaccttcactaccctggtgggaggcccagagtacgtgcactgcctgctgagcgccagagagcaatgggctgcatcgttggtggcaagac

SEQ ID NO: 257 - DNA, 24 bp, Artificial Sequence
  Description of Artificial Sequence: Synthetic primer
ctttgacaagtttgagtgttgctg

SEQ ID NO: 258 - DNA, 28 bp, Artificial Sequence
  Description of Artificial Sequence: Synthetic probe
cggctccaaaataaccctatccgaaccg

SEQ ID NO: 259 - DNA, 24 bp, Artificial Sequence
  Description of Artificial Sequence: Synthetic primer
cattttgaacagttccaacagtgc

SEQ ID NO: 260 - DNA, 84 bp, Artificial Sequence
  Description of Artificial Sequence: Synthetic oligonucleotide
ctttgacaagtttgagtgttgctggaacggttcggatagggttattttggagccgttggggcactgttggaactgttcaaaatg

SEQ ID NO: 261 - DNA, 20 bp, Artificial Sequence
  Description of Artificial Sequence: Synthetic primer
gcagatggagaagctggaag

SEQ ID NO: 262 - DNA, 19 bp, Artificial Sequence
  Description of Artificial Sequence: Synthetic probe
ctgcagtcccacatcgaag

SEQ ID NO: 263 - DNA, 21 bp, Artificial Sequence
  Description of Artificial Sequence: Synthetic primer
catgagttgtattggggaacc

SEQ ID NO: 264 - DNA, 81 bp, Artificial Sequence
  Description of Artificial Sequence: Synthetic oligonucleotide
gcagatggagaagctggaagccctggagcagctgcagtcccacatcgaaggctgggaggaggttccccaatacaactcatg

SEQ ID NO: 265 - DNA, 19 bp, Artificial Sequence
  Description of Artificial Sequence: Synthetic primer
actgcggaaagaattgcat

SEQ ID NO: 266 - DNA, 24 bp, Artificial Sequence
  Description of Artificial Sequence: Synthetic probe
agggccgtcttcagaagacccttc

SEQ ID NO: 267 - DNA, 19 bp, Artificial Sequence
  Description of Artificial Sequence: Synthetic primer
ccacctttcccagtttgtg

SEQ ID NO: 268 - DNA, 69 bp, Artificial Sequence
  Description of Artificial Sequence: Synthetic oligonucleotide
actgcggaaagaattgcatgaagggtcttctgaagacggccctggatttccacaaactgggaaaggtgg

SEQ ID NO: 269 - DNA, 20 bp, Artificial Sequence
  Description of Artificial Sequence: Synthetic primer
gcagcgtggagagtatcatc

SEQ ID NO: 270 - DNA, 27 bp, Artificial Sequence
  Description of Artificial Sequence: Synthetic probe
agcccaaacatcccctttctttggtga

SEQ ID NO: 271 - DNA, 21 bp, Artificial Sequence
  Description of Artificial Sequence: Synthetic primer
accccttctctgccttatttc

SEQ ID NO: 272 - DNA, 85 bp, Artificial Sequence
  Description of Artificial Sequence: Synthetic oligonucleotide
gcagcgtggagagtatcatctcaccaaagaaaggggatgtttgggctgaaggtgaagaagaagagaaataaggcagagaaggggt

SEQ ID NO: 273 - DNA, 18 bp, Artificial Sequence
  Description of Artificial Sequence: Synthetic primer
gccgaacgacaggacgtt

SEQ ID NO: 274 - DNA, 26 bp, Artificial Sequence
  Description of Artificial Sequence: Synthetic probe
tcttccattcctgagggagccaggcc

SEQ ID NO: 275 - DNA, 26 bp, Artificial Sequence
  Description of Artificial Sequence: Synthetic primer
catgtatacatcttccattgtttcgc

SEQ ID NO: 276 - DNA, 77 bp, Artificial Sequence
  Description of Artificial Sequence: Synthetic oligonucleotide
gccgaacgacaggacgttggggcggcctggctccctcaggaatggaagattgcgaaacaatggaagatgtatacatg

SEQ ID NO: 277 - DNA, 25 bp, Artificial Sequence
  Description of Artificial Sequence: Synthetic primer
ggaggtcaaactggcaatatttggg

SEQ ID NO: 278 - DNA, 27 bp, Artificial Sequence
  Description of Artificial Sequence: Synthetic probe
aaaggagctgcctgacttgcccacgcc

SEQ ID NO: 279 - DNA, 18 bp, Artificial Sequence
  Description of Artificial Sequence: Synthetic primer
gcccccgatgatctgggt

SEQ ID NO: 280 - DNA, 78 bp, Artificial Sequence
  Description of Artificial Sequence: Synthetic oligonucleotide
ggaggtcaaactggcaatatttgggagagcaggcgtgggcaagtaggcagctcctttgggacccagatcatcgggggc

SEQ ID NO: 281 - DNA, 20 bp, Artificial Sequence
  Description of Artificial Sequence: Synthetic primer
tgtggaggtcgagtgtcatt

SEQ ID NO: 282 - DNA, 28 bp, Artificial Sequence
  Description of Artificial Sequence: Synthetic probe
ccattttaccactatgcttgtttgagcg

SEQ ID NO: 283 - DNA, 20 bp, Artificial Sequence
  Description of Artificial Sequence: Synthetic primer
gctggtaactgccacaaatc

SEQ ID NO: 284 - DNA, 78 bp, Artificial Sequence
  Description of Artificial Sequence: Synthetic oligonucleotide
tgtggaggtcgagtgtcattacgctcaaacaagcatagtggtaaaatggatgaaaacagatttgtggcagttaccagc

SEQ ID NO: 285 - DNA, 18 bp, Artificial Sequence
  Description of Artificial Sequence: Synthetic primer
agactcgcaggagcaaca

SEQ ID NO: 286 - DNA, 25 bp, Artificial Sequence
  Description of Artificial Sequence: Synthetic probe
cttatcaggtcaaaccggcacgatg

SEQ ID NO: 287 - DNA, 20 bp, Artificial Sequence
  Description of Artificial Sequence: Synthetic primer
tggatggtgttctggttctg

SEQ ID NO: 288 - DNA, 85 bp, Artificial Sequence
  Description of Artificial Sequence: Synthetic oligonucleotide
agactcgcaggagcaacacgtgatgtgtctacttatcaggtcaaaccggcacgatgtccaggcaccagaaccagaacaccatcca

SEQ ID NO: 289 - DNA, 18 bp, Artificial Sequence
  Description of Artificial Sequence: Synthetic primer
tccttcggagccgagccg

SEQ ID NO: 290 - DNA, 24 bp, Artificial Sequence
  Description of Artificial Sequence: Synthetic probe
cccattccgcacaggaggagctgc

SEQ ID NO: 291 - DNA, 18 bp, Artificial Sequence
  Description of Artificial Sequence: Synthetic primer
gccagatgcaagccattc

SEQ ID NO: 292 - DNA, 120 bp, Artificial Sequence
  Description of Artificial Sequence: Synthetic polynucleotide
tccttcggagccgagccgtccgcgcccggcggcggcgggagcccaggagcctgccccgccctggggacgaagagctgcagctcctcctgtgcggaatgggttgaatggcttgcatctggc

SEQ ID NO: 293 - DNA, 18 bp, Artificial Sequence
  Description of Artificial Sequence: Synthetic primer
ccccgccctggggacgaa

SEQ ID NO: 294 - DNA, 30 bp, Artificial Sequence
  Description of Artificial Sequence: Synthetic probe
caacccattccgcacaggaggagctgcagc

SEQ ID NO: 295 - DNA, 27 bp, Artificial Sequence
  Description of Artificial Sequence: Synthetic primer
gccttccttagaagccagatgcaagcc

SEQ ID NO: 296 - DNA, 80 bp, Artificial Sequence
  Description of Artificial Sequence: Synthetic oligonucleotide
ccccgccctggggacgaagagctgcagctcctcctgtgcggaatgggttgaatggcttgcatctggcttctaaggaaggc

SEQ ID NO: 297 - DNA, 20 bp, Artificial Sequence
  Description of Artificial Sequence: Synthetic primer
acacttcaggcatctgcaac

SEQ ID NO: 298 - DNA, 27 bp, Artificial Sequence
  Description of Artificial Sequence: Synthetic probe
aataagccctttcttactgccacggag

SEQ ID NO: 299 - DNA, 21 bp, Artificial Sequence
  Description of Artificial Sequence: Synthetic primer
actgagggacaaaggttttga

SEQ ID NO: 300 - DNA, 68 bp, Artificial Sequence
  Description of Artificial Sequence: Synthetic oligonucleotide
acacttcaggcatctgcaacctccgtggcagtaagaaagggcttatttcaaaacctttgtccctcagt

SEQ ID NO: 301 - DNA, 20 bp, Artificial Sequence
  Description of Artificial Sequence: Synthetic primer
gacacttcaggcatctgcaa

SEQ ID NO: 302 - DNA, 20 bp, Artificial Sequence
  Description of Artificial Sequence: Synthetic probe
cctccgtggcagtaagaaag

SEQ ID NO: 303 - DNA, 20 bp, Artificial Sequence
  Description of Artificial Sequence: Synthetic primer
agccttcacacccttcttca

SEQ ID NO: 304 - DNA, 83 bp, Artificial Sequence
  Description of Artificial Sequence: Synthetic oligonucleotide
gacacttcaggcatctgcaacctccgtggcagtaagaaagatgtacagaaaggtgttcttacatgaagaagggtgtgaaggct

SEQ ID NO: 305 - DNA, 18 bp, Artificial Sequence
  Description of Artificial Sequence: Synthetic primer
agcgggacctgcgagcag

SEQ ID NO: 306 - DNA, 32 bp, Artificial Sequence
  Description of Artificial Sequence: Synthetic probe
catgtagatacgcttcccccgggctgccgccc

SEQ ID NO: 307 - DNA, 27 bp, Artificial Sequence
  Description of Artificial Sequence: Synthetic primer
tggtttgagatcacgatggacaatccc

SEQ ID NO: 308 - DNA, 85 bp, Artificial Sequence
  Description of Artificial Sequence: Synthetic oligonucleotide
agcgggacctgcgagcagcgcgggcggcagcccgggggaagcgtatctacatgaaaatgggattgtccatcgtgatctcaaacca

SEQ ID NO: 309 - DNA, 13 bp, Artificial Sequence
  Description of Artificial Sequence: Synthetic primer
tcccgggccgggg

SEQ ID NO: 310 - DNA, 26 bp, Artificial Sequence
  Description of Artificial Sequence: Synthetic probe
cgcccgccatggccaccaaggcattt

SEQ ID NO: 311 - DNA, 36 bp, Artificial Sequence
  Description of Artificial Sequence: Synthetic primer
ctccttcttgaattttttcataaatttcttttgctg

SEQ ID NO: 312 - DNA, 86 bp, Artificial Sequence
  Description of Artificial Sequence: Synthetic oligonucleotide
tcccgggccgggggacccgcccgccatggccaccaaggcatttattaatacagcaaaagaaatttatgaaaaaattcaagaaggag

SEQ ID NO: 313 - DNA, 24 bp, Artificial Sequence
  Description of Artificial Sequence: Synthetic primer
gaactgaacaaagacaacattgtt

SEQ ID NO: 314 - DNA, 32 bp, Artificial Sequence
  Description of Artificial Sequence: Synthetic probe
cctggaacgccctctttttaaaaaagattctc

SEQ ID NO: 315 - DNA, 27 bp, Artificial Sequence
  Description of Artificial Sequence: Synthetic primer
gatctttgtgtttatctttgtgtttat

SEQ ID NO: 316 - DNA, 83 bp, Artificial Sequence
  Description of Artificial Sequence: Synthetic oligonucleotide
gaactgaacaaagacaacattgttcctggaacgccctctttttaaaaaagattctcataaacacaaagataaacacaaagatc

SEQ ID NO: 317 - DNA, 23 bp, Artificial Sequence
  Description of Artificial Sequence: Synthetic primer
actggtgggaaatcaagtcgtaa

SEQ ID NO: 318 - DNA, 33 bp, Artificial Sequence
  Description of Artificial Sequence: Synthetic probe
tccacagctattttaccactttcacttgacctg

SEQ ID NO: 319 - DNA, 21 bp, Artificial Sequence
  Description of Artificial Sequence: Synthetic primer
gatgtcttcactgggtctgta

SEQ ID NO: 320 - DNA, 81 bp, Artificial Sequence
  Description of Artificial Sequence: Synthetic oligonucleotide
actggtgggaaatcaagtcgtaaaaacaggtcaagtgaaagtggtaaaatagctgtggagtacagacccagtgaagacatc

SEQ ID NO: 321 - DNA, 18 bp, Artificial Sequence
  Description of Artificial Sequence: Synthetic primer
ccctcgcttgtcttctcg

SEQ ID NO: 322 - DNA, 25 bp, Artificial Sequence
  Description of Artificial Sequence: Synthetic probe
cggccgggtcctcagacttaattca

SEQ ID NO: 323 - DNA, 22 bp, Artificial Sequence
  Description of Artificial Sequence: Synthetic primer
ttcacattcatctcatttgtgc

SEQ ID NO: 324 - DNA, 85 bp, Artificial Sequence
  Description of Artificial Sequence: Synthetic oligonucleotide
ccctcgcttgtcttctcgggcttctcgccccggccgcggccgggtcctcagacttaattcagtgcacaaatgagatgaatgtgaa

SEQ ID NO: 325 - DNA, 21 bp, Artificial Sequence
  Description of Artificial Sequence: Synthetic primer
tgcaattcagtgcagtaggat

SEQ ID NO: 326 - DNA, 33 bp, Artificial Sequence
  Description of Artificial Sequence: Synthetic probe
ctgaaactgacattatttggaaaatctacttcc

SEQ ID NO: 327 - DNA, 18 bp, Artificial Sequence
  Description of Artificial Sequence: Synthetic primer
tctgtaggggtgcttgat

SEQ ID NO: 328 - DNA, 75 bp, Artificial Sequence
  Description of Artificial Sequence: Synthetic oligonucleotide
tgcaattcagtgcagtaggatactgaaactgacattatttggaaaatctacttcctcatcaagcacccctacaga

SEQ ID NO: 329 - DNA, 18 bp, Artificial Sequence
  Description of Artificial Sequence: Synthetic primer
catcgcagtcctggacac

SEQ ID NO: 330 - DNA, 25 bp, Artificial Sequence
  Description of Artificial Sequence: Synthetic probe
tccgggcatgcagacttatttacca

SEQ ID NO: 331 - DNA, 21 bp, Artificial Sequence
  Description of Artificial Sequence: Synthetic primer
cctacgatattcctccaatgc

SEQ ID NO: 332 - DNA, 83 bp, Artificial Sequence
  Description of Artificial Sequence: Synthetic oligonucleotide
catcgcagtcctggacacgggggtcgacccgggggctccgggcatgcagacttatttaccaagcattggaggaatatcgtagg

SEQ ID NO: 333 - DNA, 19 bp, Artificial Sequence
  Description of Artificial Sequence: Synthetic primer
tgcggttgagaaaaggagg

SEQ ID NO: 334 - DNA, 30 bp, Artificial Sequence
  Description of Artificial Sequence: Synthetic probe
ccagatttcttgatgtatcccaaggtgacc

SEQ ID NO: 335 - DNA, 28 bp, Artificial Sequence
  Description of Artificial Sequence: Synthetic primer
cattcccagtactatgtatttcatgaaa

SEQ ID NO: 336 - DNA, 84 bp, Artificial Sequence
  Description of Artificial Sequence: Synthetic oligonucleotide
tgcggttgagaaaaggaggaaaatggtcaccttgggatacatcaagaaatctggaatttcatgaaatacatagtactgggaatg

SEQ ID NO: 337 - DNA, 24 bp, Artificial Sequence
  Description of Artificial Sequence: Synthetic primer
gtgttcttgacgattaatcaacag

SEQ ID NO: 338 - DNA, 30 bp, Artificial Sequence
  Description of Artificial Sequence: Synthetic probe
aggctccgcatcatttccatctgatattgg

SEQ ID NO: 339 - DNA, 24 bp, Artificial Sequence
  Description of Artificial Sequence: Synthetic primer
ccacgtgaagatgatcaatgttta

SEQ ID NO: 340 - DNA, 87 bp, Artificial Sequence
  Description of Artificial Sequence: Synthetic oligonucleotide
gtgttcttgacgattaatcaacagtccaatatcagatggaaatgatgcggagccttcgccatgtaaacattgatcatcttcacgtgg

SEQ ID NO: 341 - DNA, 20 bp, Artificial Sequence
  Description of Artificial Sequence: Synthetic primer
ccttccttataggcgtcagc

SEQ ID NO: 342 - DNA, 18 bp, Artificial Sequence
  Description of Artificial Sequence: Synthetic probe
ggaacagctagcggcaag

SEQ ID NO: 343 - DNA, 20 bp, Artificial Sequence
  Description of Artificial Sequence: Synthetic primer
ggccgagaatcttctgaatg

SEQ ID NO: 344 - DNA, 63 bp, Artificial Sequence
  Description of Artificial Sequence: Synthetic oligonucleotide
ccttccttataggcgtcagcgggggaacagctagcggcaagaacattcagaagattctcggcc

SEQ ID NO: 345 - DNA, 23 bp, Artificial Sequence
  Description of Artificial Sequence: Synthetic primer
gtctatgacatgctggctggaaa

SEQ ID NO: 346 - DNA, 25 bp, Artificial Sequence
  Description of Artificial Sequence: Synthetic probe
cgcccgaggacctctcacttgatgc

SEQ ID NO: 347 - DNA, 24 bp, Artificial Sequence
  Description of Artificial Sequence: Synthetic primer
gctggttattggaggtgtacactt

SEQ ID NO: 348 - DNA, 86 bp, Artificial Sequence
  Description of Artificial Sequence: Synthetic oligonucleotide
gtctatgacatgctggctggaaagttaattcctgtgcatcaagtgagaggtcctcgggcgggaagtgtacacctccaataaccagc

SEQ ID NO: 349 - DNA, 18 bp, Artificial Sequence
  Description of Artificial Sequence: Synthetic primer
tacctcatgggggagacg

SEQ ID NO: 350 - DNA, 26 bp, Artificial Sequence
  Description of Artificial Sequence: Synthetic probe
cagctgtgcaccacaaggttttcttc

SEQ ID NO: 351 - DNA, 20 bp, Artificial Sequence
  Description of Artificial Sequence: Synthetic primer
tctggctggctatgaaaaca

SEQ ID NO: 352 - DNA, 64 bp, Artificial Sequence
  Description of Artificial Sequence: Synthetic oligonucleotide
tacctcatgggggagacgcagctgtgcaccacaaggttttcttctgttttcatagccagccaga

SEQ ID NO: 353 - DNA, 16 bp, Artificial Sequence
  Description of Artificial Sequence: Synthetic primer
cgcgggcgggcgatgt

SEQ ID NO: 354 - DNA, 31 bp, Artificial Sequence
  Description of Artificial Sequence: Synthetic probe
caaattcagtcctgtccagagcgccgcgctc

SEQ ID NO: 355 - DNA, 26 bp, Artificial Sequence
  Description of Artificial Sequence: Synthetic primer
catcttcagcacctccagaggacatg

SEQ ID NO: 356 - DNA, 86 bp, Artificial Sequence
  Description of Artificial Sequence: Synthetic oligonucleotide
cgcgggcgggcgatgtgagcgcggcgctctggacaggactgaatttgctcttaaagaaatcatgtcctctggaggtgctgaagatg

SEQ ID NO: 357 - protein, 4 aa, Unknown
  Description of Unknown: 'DEAD' box motif family peptide
DEAD

SEQ ID NO: 358 - DNA, 100 bp, Artificial Sequence
  Description of Artificial Sequence: Synthetic polynucleotide
tcgtgccagcctcctcccccatgtaccacacctgtgtggccttcgcctgggaaatgtttgacatcatcctggatgagaaccaattggaggatgcctgcga

SEQ ID NO: 359 - DNA, 50 bp, Artificial Sequence
  Description of Artificial Sequence: Synthetic oligonucleotide
tgtgtggccttcgcctgggaaatgtttgacatcatcctggatgagaacca

SEQ ID NO: 360 - DNA, 50 bp, Artificial Sequence
  Description of Artificial Sequence: Synthetic oligonucleotide
gtgtggccttcgcctgggaaatgtttgacatcatcctggatgagaaccaa

SEQ ID NO: 361 - DNA, 50 bp, Artificial Sequence; identical to SEQ ID NO: 360
  Description of Artificial Sequence: Synthetic oligonucleotide

SEQ ID NO: 362 - DNA, 100 bp, Artificial Sequence
  Description of Artificial Sequence: Synthetic polynucleotide
tcgtgccagcctcctcccccatgtaccacacctgtgtggccttcgcctgggtgtccctcaatgcatggttctggtccacagttttccacaccagggacac

SEQ ID NO: 363 - DNA, 50 bp, Artificial Sequence
  Description of Artificial Sequence: Synthetic oligonucleotide
gtggccttcgcctgggtgtccctcaatgcatggttctggtccacagtttt

SEQ ID NO: 364 - DNA, 50 bp, Artificial Sequence; identical to SEQ ID NO: 363
  Description of Artificial Sequence: Synthetic oligonucleotide

SEQ ID NO: 365 - DNA, 50 bp, Artificial Sequence; identical to SEQ ID NO: 363
  Description of Artificial Sequence: Synthetic oligonucleotide

SEQ ID NO: 366 - DNA, 100 bp, Artificial Sequence
  Description of Artificial Sequence: Synthetic polynucleotide
acctcaatgtccaaatagcggcctcggaaaagctggcacagtgcccccctgaaatgtttgacatcatcctggatgagaaccaattggaggatgcctgcga

SEQ ID NO: 367 - DNA, 50 bp, Artificial Sequence
  Description of Artificial Sequence: Synthetic oligonucleotide
ggcctcggaaaagctggcacagtgcccccctgaaatgtttgacatcatcc

SEQ ID NO: 368 - DNA, 50 bp, Artificial Sequence
  Description of Artificial Sequence: Synthetic oligonucleotide
cggaaaagctggcacagtgcccccctgaaatgtttgacatcatcctggat

SEQ ID NO: 369 - DNA, 50 bp, Artificial Sequence
  Description of Artificial Sequence: Synthetic oligonucleotide
tggcacagtgcccccctgaaatgtttgacatcatcctggatgagaaccaa

SEQ ID NO: 370 - DNA, 50 bp, Artificial Sequence
  Description of Artificial Sequence: Synthetic oligonucleotide
ggcacagtgcccccctgaaatgtttgacatcatcctggatgagaaccaat

SEQ ID NO: 371 - DNA, 50 bp, Artificial Sequence; identical to SEQ ID NO: 370
  Description of Artificial Sequence: Synthetic oligonucleotide

SEQ ID NO: 372 - DNA, 50 bp, Artificial Sequence; identical to SEQ ID NO: 370
  Description of Artificial Sequence: Synthetic oligonucleotide

SEQ ID NO: 373 - DNA, 49 bp, Artificial Sequence
  Description of Artificial Sequence: Synthetic oligonucleotide
ggcacagtgcccccctgaaatgtttgacatcatcctggatgagaaccaa

SEQ ID NO: 374 - DNA, 50 bp, Artificial Sequence; identical to SEQ ID NO: 370
  Description of Artificial Sequence: Synthetic oligonucleotide

SEQ ID NO: 375 - DNA, 100 bp, Artificial Sequence
  Description of Artificial Sequence: Synthetic polynucleotide
tcgtgccagcctcctcccccatgtaccacacctgtgtggccttcgcctgggtaggtaacctagcaggactcctgctgtctcctcttatctaggaaggtgg

SEQ ID NO: 376 - DNA, 50 bp, Artificial Sequence
  Description of Artificial Sequence: Synthetic oligonucleotide
gtgtggccttcgcctgggtaggtaacctagcaggactcctgctgtctcct

SEQ ID NO: 377 - DNA, 50 bp, Artificial Sequence
  Description of Artificial Sequence: Synthetic oligonucleotide
gtgtggccttcgcctgggtaggtaacctagcaggactcctgctgtttcct

SEQ ID NO: 378 - DNA, 49 bp, Artificial Sequence
  Description of Artificial Sequence: Synthetic oligonucleotide
tcgcctgggtaggtaacctagcaggactcctgctgtctcctcttatcta

SEQ ID NO: 379 - DNA, 49 bp, Artificial Sequence; identical to SEQ ID NO: 378
  Description of Artificial Sequence: Synthetic oligonucleotide

SEQ ID NO: 380 - DNA, 100 bp, Artificial Sequence
  Description of Artificial Sequence: Synthetic polynucleotide
tggccatgccccactcatcccagccctgccccctaaccccgccttcacaggaaatgtttgacatcatcctggatgagaaccaattggaggatgcctgcga

SEQ ID NO: 381 - DNA, 100 bp, Artificial Sequence
  Description of Artificial Sequence: Synthetic polynucleotide
gatgacctcggacacttcaggcatctgcaacctccgtggcagtaagaaagatgtacagaaaggtgttcttacatgaagaagggtgtgaaggctgaacaat

SEQ ID NO: 382 - DNA, 50 bp, Artificial Sequence
  Description of Artificial Sequence: Synthetic oligonucleotide
ttcaggcatctgcaacctccgtggcagtaagaaagatgtacagaaaggtg

SEQ ID NO: 383 - DNA, 50 bp, Artificial Sequence; identical to SEQ ID NO: 382
  Description of Artificial Sequence: Synthetic oligonucleotide

SEQ ID NO: 384 - DNA, 50 bp, Artificial Sequence
  Description of Artificial Sequence: Synthetic oligonucleotide
caggcatctgcaacctccgtggcagtaagaaagatgtacagaaaggtgtt

SEQ ID NO: 385 - DNA, 50 bp, Artificial Sequence
  Description of Artificial Sequence: Synthetic oligonucleotide
ccgtggcagtaagaaagatgtacagaaaggtgtttttacatgaagaaggg

SEQ ID NO: 386 - DNA, 49 bp, Artificial Sequence
  Description of Artificial Sequence: Synthetic oligonucleotide
ccgtggcagtaagaaagatgtacagaaaggtgttcttacatgaagaagg

SEQ ID NO: 387 - DNA, 49 bp, Artificial Sequence; identical to SEQ ID NO: 386
  Description of Artificial Sequence: Synthetic oligonucleotide

SEQ ID NO: 388 - DNA, 48 bp, Artificial Sequence
  Description of Artificial Sequence: Synthetic oligonucleotide
gtggcagtaagaaagatgtacagaaaggtgttcttacatgaagaaggg

SEQ ID NO: 389 - DNA, 48 bp, Artificial Sequence; identical to SEQ ID NO: 388
  Description of Artificial Sequence: Synthetic oligonucleotide

SEQ ID NO: 390 - DNA, 48 bp, Artificial Sequence; identical to SEQ ID NO: 388
  Description of Artificial Sequence: Synthetic oligonucleotide

SEQ ID NO: 391 - DNA, 100 bp, Artificial Sequence
  Description of Artificial Sequence: Synthetic polynucleotide
gatgacctcggacacttcaggcatctgcaacctccgtggcagtaagaaagtcaggcccactcccaaaaacatcacggtggtggcgggcacagacctggtg

SEQ ID NO: 392 - DNA, 50 bp, Artificial Sequence
  Description of Artificial Sequence: Synthetic oligonucleotide
ccgtggcagtaagaaagtcaggcccactcccaaaaacatcacggtggtgg

SEQ ID NO: 393 - DNA, 100 bp, Artificial Sequence
  Description of Artificial Sequence: Synthetic polynucleotide
gtctaatgaccattctccatatacctttcaacctaataagtaactgtgagatgtacagaaaggtgttcttacatgaagaagggtgtgaaggctgaacaat

SEQ ID NO: 394 - DNA, 100 bp, Artificial Sequence
  Description of Artificial Sequence: Synthetic polynucleotide
gatgacctcggacacttcaggcatctgcaacctccgtggcagtaagaaaggtgagctttttcattcccgtcgcatcgggctgagccctggaccagagctg

SEQ ID NO: 395 - DNA, 50 bp, Artificial Sequence
  Description of Artificial Sequence: Synthetic oligonucleotide
ccgtggcagtaagaaaggtgagctttttcattcccgtcgcatcgggctga

SEQ ID NO: 396 - DNA, 50 bp, Artificial Sequence; identical to SEQ ID NO: 395
  Description of Artificial Sequence: Synthetic oligonucleotide

SEQ ID NO: 397 - DNA, 50 bp, Artificial Sequence; identical to SEQ ID NO: 395
  Description of Artificial Sequence: Synthetic oligonucleotide

SEQ ID NO: 398 - DNA, 50 bp, Artificial Sequence; identical to SEQ ID NO: 395
  Description of Artificial Sequence: Synthetic oligonucleotide

SEQ ID NO: 399 - DNA, 50 bp, Artificial Sequence; identical to SEQ ID NO: 395
  Description of Artificial Sequence: Synthetic oligonucleotide

SEQ ID NO: 400 - DNA, 50 bp, Artificial Sequence; identical to SEQ ID NO: 395
  Description of Artificial Sequence: Synthetic oligonucleotide

SEQ ID NO: 401 - DNA, 50 bp, Artificial Sequence
  Description of Artificial Sequence: Synthetic oligonucleotide
tggcagtaagaaaggtgagctttttcattcccgtcgcatcggactgagcc

SEQ ID NO: 402 - DNA, 50 bp, Artificial Sequence
  Description of Artificial Sequence: Synthetic oligonucleotide
aagaaaggtgagctttttcattcccgtcgcatcgggctgagccctggacc

SEQ ID NO: 403 - DNA, 50 bp, Artificial Sequence; identical to SEQ ID NO: 402
  Description of Artificial Sequence: Synthetic oligonucleotide

SEQ ID NO: 404 - DNA, 100 bp, Artificial Sequence
  Description of Artificial Sequence: Synthetic polynucleotide
gtttcacaccaaatctacaaaagcatttgtcttttatttttctcttccagatgtacagaaaggtgttcttacatgaagaagggtgtgaaggctgaacaat

SEQ ID NO: 405 - DNA, 100 bp, Artificial Sequence
  Description of Artificial Sequence: Synthetic polynucleotide
gggctggttctgaggacatggggaccacagtcaatggagatgtgtttcaggtgcccaggccttctggttggtagcggaagaccaggacaatgaccctctg

SEQ ID NO: 406 - DNA, 49 bp, Artificial Sequence
  Description of Artificial Sequence: Synthetic oligonucleotide
ggggaccacagtcaatggagatgtgtttcaggtgcccaggccttctggt

SEQ ID NO: 407 - DNA, 50 bp, Artificial Sequence
  Description of Artificial Sequence: Synthetic oligonucleotide
accacagtcaatggagatgtgtttcaggtgcccaggccttctggttggta

SEQ ID NO: 408 - DNA, 100 bp, Artificial Sequence
  Description of Artificial Sequence: Synthetic polynucleotide
gggctggttctgaggacatggggaccacagtcaatggagatgtgtttcaggaggccaacggtcctgctgatggctacgcagccattgcccaggctgacag

SEQ ID NO: 409 - DNA, 100 bp, Artificial Sequence
  Description of Artificial Sequence: Synthetic polynucleotide
gttcctagccaacatgacgtcagtgatcctgcctgaggacctgcctgtgggtgcccaggccttctggttggtagcggaagaccaggacaatgaccctctg

SEQ ID NO: 410 - DNA, 100 bp, Artificial Sequence
  Description of Artificial Sequence: Synthetic polynucleotide
cagctggttctgaggacatggggaccacagtcaatggagatgtgtttcaggtaagcaaggctctgtctcagcagtggtaaggaccaacagccctggtctc

SEQ ID NO: 411 - DNA, 100 bp, Artificial Sequence
  Description of Artificial Sequence: Synthetic polynucleotide
gcactgaaagggtggctgtggaccctgggtggcccctgtcccatccccaggtgcccaggccttctggttggtagcggaagaccaggacaatgaccctctg

SEQ ID NO: 412 - DNA, 100 bp, Artificial Sequence
  Description of Artificial Sequence: Synthetic polynucleotide
gcggcgagcccttccttataggcgtcagcgggggaacagctagcggcaagaacattcagaagattctcggccttgccccttcacgagccgccaccaagca

SEQ ID NO: 413 - DNA, 50 bp, Artificial Sequence
  Description of Artificial Sequence: Synthetic oligonucleotide
cagcgggggaacagctagcggcaagaacattcagaagattctcggccttg

SEQ ID NO: 414 - DNA, 49 bp, Artificial Sequence
  Description of Artificial Sequence: Synthetic oligonucleotide
cgggggaacagctagcggcaagaacattcagaagattctcggccttgcc

SEQ ID NO: 415 - DNA, 49 bp, Artificial Sequence
  Description of Artificial Sequence: Synthetic oligonucleotide
gggggaacagctagcggcaagaacattcagaagattctcggccttgccc

SEQ ID NO: 416 - DNA, 49 bp, Artificial Sequence; identical to SEQ ID NO: 415
  Description of Artificial Sequence: Synthetic oligonucleotide

SEQ ID NO: 417 - DNA, 50 bp, Artificial Sequence
  Description of Artificial Sequence: Synthetic oligonucleotide
agcggcaagaacattcagaagattctcggccttgccccttcacgagccgc

SEQ ID NO: 418 - DNA, 100 bp, Artificial Sequence
  Description of Artificial Sequence: Synthetic polynucleotide
gcggcgagcccttccttataggcgtcagcgggggaacagctagcggcaagtcttccgtgtgtgctaagatcgtgcagctcctggggcagaatgaggtgga

SEQ ID NO: 419 - DNA, 50 bp, Artificial Sequence
  Description of Artificial Sequence: Synthetic oligonucleotide
cagcgggggaacagctagcggcaagtcttccgtgtgtgctaagatcgtgc

SEQ ID NO: 420 - DNA, 50 bp, Artificial Sequence
  Description of Artificial Sequence: Synthetic oligonucleotide
gcgggggaacagctagcggcaagtcttccgtgtgtgctaagatcgtgcag

SEQ ID NO: 421 - DNA, 50 bp, Artificial Sequence
  Description of Artificial Sequence: Synthetic oligonucleotide
cgggggaacagctagcggcaagtcttccgtgtgtgctaagatcgtgcagc

SEQ ID NO: 422 - DNA, 49 bp, Artificial Sequence
  Description of Artificial Sequence: Synthetic oligonucleotide
gggggaacagctagcggcaagtcttccgtgtgtgctaagatcgtgcagc

SEQ ID NO: 423 - DNA, 49 bp, Artificial Sequence; identical to SEQ ID NO: 422
  Description of Artificial Sequence: Synthetic oligonucleotide

SEQ ID NO: 424 - DNA, 49 bp, Artificial Sequence; identical to SEQ ID NO: 422
  Description of Artificial Sequence: Synthetic oligonucleotide

SEQ ID NO: 425 - DNA, 100 bp, Artificial Sequence
  Description of Artificial Sequence: Synthetic polynucleotide
actgttccttcattttcctgtatattctctgtactatgtcgattcgacagaacattcagaagattctcggccttgccccttcacgagccgccaccaagca

SEQ ID NO: 426 - DNA, 100 bp, Artificial Sequence
  Description of Artificial Sequence: Synthetic polynucleotide
gcggcgagcccttccttataggcgtcagcgggggaacagctagcggcaaggtacggcggggcccggagccgcgctcccttcccggcttctgtccctgggc

SEQ ID NO: 427 - DNA, 100 bp, Artificial Sequence
  Description of Artificial Sequence: Synthetic polynucleotide
ttctgtatatttgatattaaaacccaatccttactgtgctttcttcacagaacattcagaagattctcggccttgccccttcacgagccgccaccaagca

SEQ ID NO: 428 - DNA, 100 bp, Artificial Sequence
  Description of Artificial Sequence: Synthetic polynucleotide
ggcggcctcctgcagcgggcggccccctgcagcctcctgcccaggctccgattcaagaatggctttgtttaaattgccaaacccagagagcaatatcagg

SEQ ID NO: 429 - DNA, 49 bp, Artificial Sequence
  Description of Artificial Sequence: Synthetic oligonucleotide
tgcagcctcctgcccaggctccgattcaagaatggctttgtttaaattg

SEQ ID NO: 430 - DNA, 49 bp, Artificial Sequence; identical to SEQ ID NO: 429
  Description of Artificial Sequence: Synthetic oligonucleotide

SEQ ID NO: 431 - DNA, 49 bp, Artificial Sequence; identical to SEQ ID NO: 429
  Description of Artificial Sequence: Synthetic oligonucleotide

SEQ ID NO: 432 - DNA, 100 bp, Artificial Sequence
  Description of Artificial Sequence: Synthetic polynucleotide
ggcggcctcctgcagcgggcggccccctgcagcctcctgcccaggctccggacatggacatcttccagcaacagatctcgagaagacagctggctaaaat

SEQ ID NO: 433 - DNA, 50 bp, Artificial Sequence
  Description of Artificial Sequence: Synthetic oligonucleotide
ggccccctgcagcctcctgcccaggctccggacatggacatcttccagca

SEQ ID NO: 434 - DNA, 50 bp, Artificial Sequence; identical to SEQ ID NO: 433
  Description of Artificial Sequence: Synthetic oligonucleotide

SEQ ID NO: 435 - DNA, 50 bp, Artificial Sequence; identical to SEQ ID NO: 433
  Description of Artificial Sequence: Synthetic oligonucleotide

SEQ ID NO: 436 - DNA, 50 bp, Artificial Sequence
  Description of Artificial Sequence: Synthetic oligonucleotide
cctgcccaggctccggacatggacatcttccagcaacagatctcgagaag

SEQ ID NO: 437 - DNA, 50 bp, Artificial Sequence
  Description of Artificial Sequence: Synthetic oligonucleotide
gcccaggctccggacatggacatcttccagcaacagatctcgagaagaca

SEQ ID NO: 438 - DNA, 50 bp, Artificial Sequence; identical to SEQ ID NO: 437
  Description of Artificial Sequence: Synthetic oligonucleotide

SEQ ID NO: 439 - DNA, 50 bp, Artificial Sequence; identical to SEQ ID NO: 437
  Description of Artificial Sequence: Synthetic oligonucleotide

SEQ ID NO: 440 - DNA, 50 bp, Artificial Sequence; identical to SEQ ID NO: 437
  Description of Artificial Sequence: Synthetic oligonucleotide

SEQ ID NO: 441 - DNA, 50 bp, Artificial Sequence; identical to SEQ ID NO: 437
  Description of Artificial Sequence: Synthetic oligonucleotide

SEQ ID NO: 442 - DNA, 50 bp, Artificial Sequence; identical to SEQ ID NO: 437
  Description of Artificial Sequence: Synthetic oligonucleotide

SEQ ID NO: 443 - DNA, 50 bp, Artificial Sequence; identical to SEQ ID NO: 437
  Description of Artificial Sequence: Synthetic oligonucleotide

SEQ ID NO: 444 - DNA, 50 bp, Artificial Sequence; identical to SEQ ID NO: 437
  Description of Artificial Sequence: Synthetic oligonucleotide

SEQ ID NO: 445 - DNA, 50 bp, Artificial Sequence; identical to SEQ ID NO: 437
  Description of Artificial Sequence: Synthetic oligonucleotide

SEQ ID NO: 446 - DNA, 50 bp, Artificial Sequence; identical to SEQ ID NO: 437
  Description of Artificial Sequence: Synthetic oligonucleotide

SEQ ID NO: 447 - DNA, 50 bp, Artificial Sequence; identical to SEQ ID NO: 437
  Description of Artificial Sequence: Synthetic oligonucleotide

SEQ ID NO: 448 - DNA, 50 bp, Artificial Sequence
  Description of Artificial Sequence: Synthetic oligonucleotide
gcccaggctccggacatggacatcttccagcaacagacctcgagaagaca

SEQ ID NO: 449 - DNA, 50 bp, Artificial Sequence; identical to SEQ ID NO: 437
  Description of Artificial Sequence: Synthetic oligonucleotide

SEQ ID NO: 450 - DNA, 50 bp, Artificial Sequence
  Description of Artificial Sequence: Synthetic oligonucleotide
caggctccggacatggacatcttccagcaacagatctcgagaagacagct

SEQ ID NO: 451 - DNA, 100 bp, Artificial Sequence
  Description of Artificial Sequence: Synthetic polynucleotide
atcaagtgtgtaatctctgtggatttaaccctacaccacatttgactgagattcaagaatggctttgtttaaattgccaaacccagagagcaatatcagg

SEQ ID NO: 452 - DNA, 100 bp, Artificial Sequence
  Description of Artificial Sequence: Synthetic polynucleotide
ggcggcctcctgcagcgggcggccccctgcagcctcctgcccaggctccggtgagcagcgccgcccttcccgggaggtgccggggaggggccgccgcgag

SEQ ID NO: 453 - DNA, 100 bp, Artificial Sequence
  Description of Artificial Sequence: Synthetic polynucleotide
agatacattataatacattcaatctgttcattgtaatttttttcccacagattcaagaatggctttgtttaaattgccaaacccagagagcaatatcagg

SEQ ID NO: 454 - DNA, 100 bp, Artificial Sequence
  Description of Artificial Sequence: Synthetic polynucleotide
ggaatggacttcgatgatgaagatggtgaaggccccagtaaattttcaagaaagatgatgacattgaagaaggagatcttccagagcacaagagaccttc

SEQ ID NO: 455 - DNA, 50 bp, Artificial Sequence
  Description of Artificial Sequence: Synthetic oligonucleotide
aggccccagtaaattttcaagaaagatgatgacattgaagaaggagatct

SEQ ID NO: 456 - DNA, 50 bp, Artificial Sequence; identical to SEQ ID NO: 455
  Description of Artificial Sequence: Synthetic oligonucleotide

SEQ ID NO: 457 - DNA, 50 bp, Artificial Sequence; identical to SEQ ID NO: 455
  Description of Artificial Sequence: Synthetic oligonucleotide

SEQ ID NO: 458 - DNA, 100 bp, Artificial Sequence
  Description of Artificial Sequence: Synthetic polynucleotide
ggaatggacttcgatgatgaagatggtgaaggccccagtaaattttcaagagagaatcatagtgaaatcgaaaggcgcagacggaacaagatgactcagt

SEQ ID NO: 459 - DNA, 50 bp, Artificial Sequence
  Description of Artificial Sequence: Synthetic oligonucleotide
gaaggccccagtaaattttcaagagagaatcatagtgaaatcgaaaggcg

SEQ ID NO: 460 - DNA, 50 bp, Artificial Sequence
  Description of Artificial Sequence: Synthetic oligonucleotide
aggcccccgtaaattttcaagagagaatcatagtgaaatcgaaaggcgca

SEQ ID NO: 461 - DNA, 100 bp, Artificial Sequence
  Description of Artificial Sequence: Synthetic polynucleotide
ttcgcgattacaatgatgcagacatggcgcgtcttctggagcaatgggagaaagatgatgacattgaagaaggagatcttccagagcacaagagaccttc

SEQ ID NO: 462 - DNA, 50 bp, Artificial Sequence
  Description of Artificial Sequence: Synthetic oligonucleotide
ggagcaatgggagaaagatgatgacattgaagaaggagatcttccagagc

SEQ ID NO: 463 - DNA, 50 bp, Artificial Sequence; identical to SEQ ID NO: 462
  Description of Artificial Sequence: Synthetic oligonucleotide

SEQ ID NO: 464 - DNA, 50 bp, Artificial Sequence
  Description of Artificial Sequence: Synthetic oligonucleotide
gggagaaagatgatgacattgaagaaggagatcttccagagcacaagaga

SEQ ID NO: 465 - DNA, 50 bp, Artificial Sequence; identical to SEQ ID NO: 464
  Description of Artificial Sequence: Synthetic oligonucleotide

SEQ ID NO: 466 - DNA, 50 bp, Artificial Sequence; identical to SEQ ID NO: 464
  Description of Artificial Sequence: Synthetic oligonucleotide

SEQ ID NO: 467 - DNA, 100 bp, Artificial Sequence
  Description of Artificial Sequence: Synthetic polynucleotide
agaatggacttcgatgatgaagatggtgaaggccccagtaaattttcaaggtaagtttattttattttccttagacttaaagaaggcaatagccagcatt

SEQ ID NO: 468 - DNA, 100 bp, Artificial Sequence
  Description of Artificial Sequence: Synthetic polynucleotide
aaaagcaagattctgatgataggtttgatgcttttcccctaatctgatagaaagatgatgacattgaagaaggagatcttccagagcacaagagaccttc

SEQ ID NO: 469 - DNA, 50 bp, Artificial Sequence
  Description of Artificial Sequence: Synthetic oligonucleotide
gatgataggtttgatgcttttcccctaatctgatagaaagatgatgacat

SEQ ID NO: 470 - DNA, 50 bp, Artificial Sequence
  Description of Artificial Sequence: Synthetic oligonucleotide
cccctaatctgatagaaagatgatgacattgaagaaggagatctttcaga

SEQ ID NO: 471 - DNA, 50 bp, Artificial Sequence; identical to SEQ ID NO: 470
  Description of Artificial Sequence: Synthetic oligonucleotide

SEQ ID NO: 472 - DNA, 100 bp, Artificial Sequence
  Description of Artificial Sequence: Synthetic polynucleotide
atctgttctacaggaagatgctgagaaactgcggaaagaattgcatgaagggtcttctgaagacggccctggatttccacaaactgggaaaggtggagtt

SEQ ID NO: 473 - DNA, 50 bp, Artificial Sequence
  Description of Artificial Sequence: Synthetic oligonucleotide
gcggaaagaattgcatgaagggtcttctgaagacggccctggatttccac

SEQ ID NO: 474 - DNA, 50 bp, Artificial Sequence
  Description of Artificial Sequence: Synthetic oligonucleotide
aattgcatgaagggtcttctgaagacggccctggatttccacaaactggg

SEQ ID NO: 475 - DNA, 100 bp, Artificial Sequence
  Description of Artificial Sequence: Synthetic polynucleotide
atctgttctacaggaagatgctgagaaactgcggaaagaattgcatgaagtttgccatctcttggagcaagagcgacaacaacacaaccagttaaaacat

SEQ ID NO: 476 - DNA, 50 bp, Artificial Sequence
  Description of Artificial Sequence: Synthetic oligonucleotide
gagaaactgcggaaagaattgcatgaagtttgccatctcttggagcaaga

SEQ ID NO: 477 - DNA, 50 bp, Artificial Sequence; identical to SEQ ID NO: 476
  Description of Artificial Sequence: Synthetic oligonucleotide

SEQ ID NO: 478 - DNA, 50 bp, Artificial Sequence; identical to SEQ ID NO: 476
  Description of Artificial Sequence: Synthetic oligonucleotide

SEQ ID NO: 479 - DNA, 50 bp, Artificial Sequence; identical to SEQ ID NO: 476
  Description of Artificial Sequence: Synthetic oligonucleotide

SEQ ID NO: 480 - DNA, 50 bp, Artificial Sequence
  Description of Artificial Sequence: Synthetic oligonucleotide
gcggaaagaattgcatgaagtttgccatctcttggagcaagagcgacaac

SEQ ID NO: 481 - DNA, 50 bp, Artificial Sequence; identical to SEQ ID NO: 480
  Description of Artificial Sequence: Synthetic oligonucleotide

SEQ ID NO: 482 - DNA, 50 bp, Artificial Sequence
  Description of Artificial Sequence: Synthetic oligonucleotide
gcggaaagaattgcatgaagtttgccatctcttggagcaagagcgataac

SEQ ID NO: 483 - DNA, 50 bp, Artificial Sequence; identical to SEQ ID NO: 480
  Description of Artificial Sequence: Synthetic oligonucleotide

SEQ ID NO: 484 - DNA, 50 bp, Artificial Sequence; identical to SEQ ID NO: 480
  Description of Artificial Sequence: Synthetic oligonucleotide

SEQ ID NO: 485 - DNA, 50 bp, Artificial Sequence; identical to SEQ ID NO: 480
  Description of Artificial Sequence: Synthetic oligonucleotide

SEQ ID NO: 486 - DNA, 50 bp, Artificial Sequence; identical to SEQ ID NO: 482
  Description of Artificial Sequence: Synthetic oligonucleotide

SEQ ID NO: 487 - DNA, 50 bp, Artificial Sequence; identical to SEQ ID NO: 480
  Description of Artificial Sequence: Synthetic oligonucleotide

SEQ ID NO: 488 - DNA, 50 bp, Artificial Sequence; identical to SEQ ID NO: 480
  Description of Artificial Sequence: Synthetic oligonucleotide

SEQ ID NO: 489 - DNA, 50 bp, Artificial Sequence
  Description of Artificial Sequence: Synthetic oligonucleotide
attgcatgaagtttgccatctcttggagcaagagcgacaacaacacaacc

SEQ ID NO: 490 - DNA, 100 bp, Artificial Sequence
  Description of Artificial Sequence: Synthetic polynucleotide
tggtctttgtgcgattggatggcttcctgggacaactgcacgtggtggagggtcttctgaagacggccctggatttccacaaactgggaaaggtggagtt

SEQ ID NO: 491 - DNA, 100 bp, Artificial Sequence
  Description of Artificial Sequence: Synthetic polynucleotide
atctgttctacaggaagatgctgagaaactgcggaaagaattgcatgaaggtaaatatactgtatatttttatctttgtctctaagaaccatataagtta

SEQ ID NO: 492 - DNA, 50 bp, Artificial Sequence
  Description of Artificial Sequence: Synthetic oligonucleotide
gagaaactgcggaaagaattgcatgaaggtaaatatactgtatattttta

SEQ ID NO: 493 - DNA, 50 bp, Artificial Sequence
  Description of Artificial Sequence: Synthetic oligonucleotide
gcggaaagaattgcatgaaggtaaatatactgtatatttttatctttgtc

SEQ ID NO: 494 - DNA, 50 bp, Artificial Sequence; identical to SEQ ID NO: 493
  Description of Artificial Sequence: Synthetic oligonucleotide

SEQ ID NO: 495 - DNA, 100 bp, Artificial Sequence
  Description of Artificial Sequence: Synthetic polynucleotide
cgatagtttgctgagaatgattttaacttttttgtgaattgtccccatagggtcttctgaagacggccctggatttccacaaactgggaaaggtggagtt

SEQ ID NO: 496 - DNA, 50 bp, Artificial Sequence
  Description of Artificial Sequence: Synthetic oligonucleotide
gattttaacttttttgtgaattgtccccatagggtcttctgaagacggcc

SEQ ID NO: 497 - DNA, 100 bp, Artificial Sequence
  Description of Artificial Sequence: Synthetic polynucleotide
gagcccagcggctacacggtgcgcgaggccggcccgccggcattctacagtccaccaatcgattactttgatgtatttaaagaatcaaaagagcaaaatt

SEQ ID NO: 498 - DNA, 50 bp, Artificial Sequence
  Description of Artificial Sequence: Synthetic oligonucleotide
cgccggcattctacagtccaccaatcgattactttgatgtatttaaagaa

SEQ ID NO: 499 - DNA, 50 bp, Artificial Sequence; identical to SEQ ID NO: 498
  Description of Artificial Sequence: Synthetic oligonucleotide

SEQ ID NO: 500 - DNA, 50 bp, Artificial Sequence; identical to SEQ ID NO: 498
  Description of Artificial Sequence: Synthetic oligonucleotide

SEQ ID NO: 501 - DNA, 50 bp, Artificial Sequence; identical to SEQ ID NO: 498
  Description of Artificial Sequence: Synthetic oligonucleotide

SEQ ID NO: 502 - DNA, 100 bp, Artificial Sequence
  Description of Artificial Sequence: Synthetic polynucleotide
gagcccagcggctacacggtgcgcgaggccggcccgccggcattctacaggccaaattcagataatcgacgccagggtggcagagaaagattggccagta

SEQ ID NO: 503 - DNA, 50 bp, Artificial Sequence
  Description of Artificial Sequence: Synthetic oligonucleotide
cggtgcgcgaggccggcccgccggcattctacaggccaaattcagataat

SEQ ID NO: 504 - DNA, 49 bp, Artificial Sequence
  Description of Artificial Sequence: Synthetic oligonucleotide
cggtgcgcgaggccggcccgccggcattctacaggccaaattcagataa

SEQ ID NO: 505 - DNA, 50 bp, Artificial Sequence
  Description of Artificial Sequence: Synthetic oligonucleotide
ggtgcgcgaggccggcccgccggcattctacaggccaaattcagataatc

SEQ ID NO: 506 - DNA, 50 bp, Artificial Sequence; identical to SEQ ID NO: 505
  Description of Artificial Sequence: Synthetic oligonucleotide

SEQ ID NO: 507 - DNA, 50 bp, Artificial Sequence; identical to SEQ ID NO: 505
  Description of Artificial Sequence: Synthetic oligonucleotide

SEQ ID NO: 508 - DNA, 50 bp, Artificial Sequence; identical to SEQ ID NO: 505
  Description of Artificial Sequence: Synthetic oligonucleotide

SEQ ID NO: 509 - DNA, 50 bp, Artificial Sequence; identical to SEQ ID NO: 505
  Description of Artificial Sequence: Synthetic oligonucleotide

SEQ ID NO: 510 - DNA, 50 bp, Artificial Sequence
  Description of Artificial Sequence: Synthetic oligonucleotide
gtgcgcgaggccggcccgtcggcattctacaggccaaattcagataatcg

SEQ ID NO: 511 - DNA, 50 bp, Artificial Sequence; identical to SEQ ID NO: 510
  Description of Artificial Sequence: Synthetic oligonucleotide

SEQ ID NO: 512 - DNA, 48 bp, Artificial Sequence
  Description of Artificial Sequence: Synthetic oligonucleotide
gtgcgcgaggccggcccgccggcattctacaggccaaattcagataat

SEQ ID NO: 513 - DNA, 50 bp, Artificial Sequence; identical to SEQ ID NO: 510
  Description of Artificial Sequence: Synthetic oligonucleotide

SEQ ID NO: 514 - DNA, 50 bp, Artificial Sequence
  Description of Artificial Sequence: Synthetic oligonucleotide
gcgcgaggccggcccgccggcattctacaggccaagttcagataatcgac

SEQ ID NO: 515 - DNA, 50 bp, Artificial Sequence
  Description of Artificial Sequence: Synthetic oligonucleotide
gcgcgaggccggcccgccggcattctacaggccaaattcagataatcgac

SEQ ID NO: 516 - DNA, 50 bp, Artificial Sequence
  Description of Artificial Sequence: Synthetic oligonucleotide
gcgcgaggccggcccaccggcattctacaggccaaattcagataatcgac

SEQ ID NO: 517 - DNA, 50 bp, Artificial Sequence; identical to SEQ ID NO: 515
  Description of Artificial Sequence: Synthetic oligonucleotide

SEQ ID NO: 518 - DNA, 50 bp, Artificial Sequence; identical to SEQ ID NO: 515
  Description of Artificial Sequence: Synthetic oligonucleotide

SEQ ID NO: 519 - DNA, 50 bp, Artificial Sequence
  Description of Artificial Sequence: Synthetic oligonucleotide
gcgcgaggccggcccgccggcatgctacaggccaaattcagataatcgac

SEQ ID NO: 520 - DNA, 50 bp, Artificial Sequence; identical to SEQ ID NO: 515
  Description of Artificial Sequence: Synthetic oligonucleotide

SEQ ID NO: 521 - DNA, 50 bp, Artificial Sequence; identical to SEQ ID NO: 515
  Description of Artificial Sequence: Synthetic oligonucleotide

SEQ ID NO: 522 - DNA, 50 bp, Artificial Sequence; identical to SEQ ID NO: 516
  Description of Artificial Sequence: Synthetic oligonucleotide

SEQ ID NO: 523 - DNA, 50 bp, Artificial Sequence; identical to SEQ ID NO: 516
  Description of Artificial Sequence: Synthetic oligonucleotide

SEQ ID NO: 524 - DNA, 50 bp, Artificial Sequence; identical to SEQ ID NO: 515
  Description of Artificial Sequence: Synthetic oligonucleotide

SEQ ID NO: 525 - DNA, 50 bp, Artificial Sequence
  Description of Artificial Sequence: Synthetic oligonucleotide
cgcgaggccggcccgtcggcattctacaggccaaattcagataatcgacg

SEQ ID NO: 526 - DNA, 50 bp, Artificial Sequence
  Description of Artificial Sequence: Synthetic oligonucleotide
gcccgccggcgttctacaggccaaattcagataatcgacgccagggtggc

SEQ ID NO: 527 - DNA, 50 bp, Artificial Sequence
  Description of Artificial Sequence: Synthetic oligonucleotide
ccgctggcattctacaggccaaattcagataatcgacgccagggtggcag

SEQ ID NO: 528 - DNA, 50 bp, Artificial Sequence
  Description of Artificial Sequence: Synthetic oligonucleotide
gccggcattctacaggccaaattcagataatcgacgccagggtggcagag

SEQ ID NO: 529 - DNA, 100 bp, Artificial Sequence
  Description of Artificial Sequence: Synthetic polynucleotide
ttggtagaatgttacatgtatcgaagaattcatgaagcaattatccagagtccaccaatcgattactttgatgtatttaaagaatcaaaagagcaaaatt

SEQ ID NO: 530 - DNA, 100 bp, Artificial Sequence
  Description of Artificial Sequence: Synthetic polynucleotide
gagcccagcggctacacggtgcgcgaggccggcccgccggcattctacaggtacccgcgcccgcgccgcccgtcggggtggccgccgcgcccggcaggag

SEQ ID NO: 531 - DNA, 100 bp, Artificial Sequence
  Description of Artificial Sequence: Synthetic polynucleotide
atccaaatgtacaaactaaaatgtttcactttgtttttctcctactttagtccaccaatcgattactttgatgtatttaaagaatcaaaagagcaaaatt

SEQ ID NO: 532 - DNA, 100 bp, Artificial Sequence
  Description of Artificial Sequence: Synthetic polynucleotide
ggcagacagggagctggttcacatgatcaactgggcgaagagggtgccagttggacagagagactctgaagatgtgagcaaaagagactccgataaagag

SEQ ID NO: 533 - DNA, 50 bp, Artificial Sequence
  Description of Artificial Sequence: Synthetic oligonucleotide
gggagctggttcacatgatcaactgggcgaagagggtgccagttggacag

SEQ ID NO: 534 - DNA, 49 bp, Artificial Sequence
  Description of Artificial Sequence: Synthetic oligonucleotide
gggagctggttcacatgatcaactgggcgaagagggtgccagttggaca

SEQ ID NO: 535 - DNA, 50 bp, Artificial Sequence; identical to SEQ ID NO: 533
  Description of Artificial Sequence: Synthetic oligonucleotide

SEQ ID NO: 536 - DNA, 50 bp, Artificial Sequence
  Description of Artificial Sequence: Synthetic oligonucleotide
agctggttcacatgatcaactgggcgaagagggtgccagttggacagaga

SEQ ID NO: 537 - DNA, 50 bp, Artificial Sequence
  Description of Artificial Sequence: Synthetic oligonucleotide
ggttcacatgatcaactgggtgaagagggtgccagttggacagagagact

SEQ ID NO: 538 - DNA, 50 bp, Artificial Sequence
  Description of Artificial Sequence: Synthetic oligonucleotide
ggttcacatgatcaactgggcgaagagggtgccagttggacagagagact

SEQ ID NO: 539 - DNA, 50 bp, Artificial Sequence; identical to SEQ ID NO: 538
  Description of Artificial Sequence: Synthetic oligonucleotide

SEQ ID NO: 540 - DNA, 50 bp, Artificial Sequence; identical to SEQ ID NO: 538
  Description of Artificial Sequence: Synthetic oligonucleotide

SEQ ID NO: 541 - DNA, 50 bp, Artificial Sequence; identical to SEQ ID NO: 538
  Description of Artificial Sequence: Synthetic oligonucleotide

SEQ ID NO: 542 - DNA, 50 bp, Artificial Sequence; identical to SEQ ID NO: 538
  Description of Artificial Sequence: Synthetic oligonucleotide

SEQ ID NO: 543 - DNA, 50 bp, Artificial Sequence; identical to SEQ ID NO: 538
  Description of Artificial Sequence: Synthetic oligonucleotide

SEQ ID NO: 544 - DNA, 49 bp, Artificial Sequence
  Description of Artificial Sequence: Synthetic oligonucleotide
ctgggcgaagagggtgccagttggacagagagactctgaagatgtgagc

SEQ ID NO: 545 - DNA, 49 bp, Artificial Sequence; identical to SEQ ID NO: 544
  Description of Artificial Sequence: Synthetic oligonucleotide

SEQ ID NO: 546 - DNA, 48 bp, Artificial Sequence
  Description of Artificial Sequence: Synthetic oligonucleotide
tgggcgaagagggtgccagttggacagagagactctgaagatgtgagc

SEQ ID NO: 547 - DNA, 48 bp, Artificial Sequence; identical to SEQ ID NO: 546
  Description of Artificial Sequence: Synthetic oligonucleotide

SEQ ID NO: 548 - DNA, 47 bp, Artificial Sequence
  Description of Artificial Sequence: Synthetic oligonucleotide
gggcgaagagggtgccagttggacagagagactctgaagatgtgagc

SEQ ID NO: 549 - DNA, 47 bp, Artificial Sequence; identical to SEQ ID NO: 548
  Description of Artificial Sequence: Synthetic oligonucleotide

SEQ ID NO: 550 - DNA, 47 bp, Artificial Sequence; identical to SEQ ID NO: 548
  Description of Artificial Sequence: Synthetic oligonucleotide

SEQ ID NO: 551 - DNA, 47 bp, Artificial Sequence; identical to SEQ ID NO: 548
  Description of Artificial Sequence: Synthetic oligonucleotide

SEQ ID NO: 552 - DNA, 47 bp, Artificial Sequence; identical to SEQ ID NO: 548
  Description of Artificial Sequence: Synthetic oligonucleotide

SEQ ID NO: 553 - DNA, 47 bp, Artificial Sequence; identical to SEQ ID NO: 548
  Description of Artificial Sequence: Synthetic oligonucleotide

SEQ ID NO: 554 - DNA, 47 bp, Artificial Sequence; identical to SEQ ID NO: 548
  Description of Artificial Sequence: Synthetic oligonucleotide

SEQ ID NO: 555 - DNA, 50 bp, Artificial Sequence
  Description of Artificial Sequence: Synthetic oligonucleotide
aagagggtgccagttggacagagagactctgaagatgtgagcgaaagaga

SEQ ID NO: 556 - DNA, 50 bp, Artificial Sequence
  Description of Artificial Sequence: Synthetic oligonucleotide
agagggtgccagttggacagagagactctgaagatgtgagcgaaagagac

SEQ ID NO: 557 - DNA, 50 bp, Artificial Sequence; identical to SEQ ID NO: 556
  Description of Artificial Sequence: Synthetic oligonucleotide

SEQ ID NO: 558 - DNA, 50 bp, Artificial Sequence; identical to SEQ ID NO: 556
  Description of Artificial Sequence: Synthetic oligonucleotide

SEQ ID NO: 559 - DNA, 50 bp, Artificial Sequence; identical to SEQ ID NO: 556
  Description of Artificial Sequence: Synthetic oligonucleotide

SEQ ID NO: 560 - DNA, 50 bp, Artificial Sequence
  Description of Artificial Sequence: Synthetic oligonucleotide
gagggtgccagttggacagagagactctgaagatgtgagcgaaagagact

SEQ ID NO: 561 - DNA, 50 bp, Artificial Sequence; identical to SEQ ID NO: 560
  Description of Artificial Sequence: Synthetic oligonucleotide

SEQ ID NO: 562 - DNA, 50 bp, Artificial Sequence; identical to SEQ ID NO: 560
  Description of Artificial Sequence: Synthetic oligonucleotide

SEQ ID NO: 563 - DNA, 50 bp, Artificial Sequence; identical to SEQ ID NO: 560
  Description of Artificial Sequence: Synthetic oligonucleotide

SEQ ID NO: 564 - DNA, 50 bp, Artificial Sequence
  Description of Artificial Sequence: Synthetic oligonucleotide
agggtgccagttggacagagagactctgaagatgtgagcgaaagagactc

SEQ ID NO: 565 - DNA, 50 bp, Artificial Sequence
  Description of Artificial Sequence: Synthetic oligonucleotide
gggtgccagttggacagagagactctgaagatgtgagcgaaagagactcc

SEQ ID NO: 566 - DNA, 50 bp, Artificial Sequence
  Description of Artificial Sequence: Synthetic oligonucleotide
ggtgccagttggacagagagactctgaagatgtgagcgaaagagactccg

SEQ ID NO: 567 - DNA, 50 bp, Artificial Sequence; identical to SEQ ID NO: 566
  Description of Artificial Sequence: Synthetic oligonucleotide

SEQ ID NO: 568 - DNA, 50 bp, Artificial Sequence; identical to SEQ ID NO: 566
  Description of Artificial Sequence: Synthetic oligonucleotide

SEQ ID NO: 569 - DNA, 50 bp, Artificial Sequence
  Description of Artificial Sequence: Synthetic oligonucleotide
gtgccagttggacagagagactctgaagatgtgagcgaaagagactccga

SEQ ID NO: 570 - DNA, 50 bp, Artificial Sequence; identical to SEQ ID NO: 569
  Description of Artificial Sequence: Synthetic oligonucleotide

SEQ ID NO: 571 - DNA, 50 bp, Artificial Sequence; identical to SEQ ID NO: 569
  Description of Artificial Sequence: Synthetic oligonucleotide

SEQ ID NO: 572 - DNA, 50 bp, Artificial Sequence
  Description of Artificial Sequence: Synthetic oligonucleotide
tgccagttggacagagagactctgaagatgtgagcgaaagagactccgat

SEQ ID NO: 573 - DNA, 50 bp, Artificial Sequence
  Description of Artificial Sequence: Synthetic oligonucleotide
gccagttggacagagagactctgaagatgtgagcgaaagagactccgata

SEQ ID NO: 574 - DNA, 100 bp, Artificial Sequence
  Description of Artificial Sequence: Synthetic polynucleotide
ggcagacagggagctggttcacatgatcaactgggcgaagagggtgccaggctttgtggatttgaccctccatgatcaggtccaccttctagaatgtgcc

SEQ ID NO: 575 - DNA, 50 bp, Artificial Sequence
  Description of Artificial Sequence: Synthetic oligonucleotide
actgggcgaagagggtgccaggctttgtggatttgaccctccatgatcag

SEQ ID NO: 576 - DNA, 50 bp, Artificial Sequence; identical to SEQ ID NO: 575
  Description of Artificial Sequence: Synthetic oligonucleotide

SEQ ID NO: 577 - DNA, 50 bp, Artificial Sequence; identical to SEQ ID NO: 575
  Description of Artificial Sequence: Synthetic oligonucleotide

SEQ ID NO: 578 - DNA, 50 bp, Artificial Sequence; identical to SEQ ID NO: 575
  Description of Artificial Sequence: Synthetic oligonucleotide

SEQ ID NO: 579 - DNA, 50 bp, Artificial Sequence
  Description of Artificial Sequence: Synthetic oligonucleotide
ctgggcgaagagggtgccaggctttgtggatttgaccctccatgatcagg

SEQ ID NO: 580 - DNA, 50 bp, Artificial Sequence
  Description of Artificial Sequence: Synthetic oligonucleotide
gggcgaagagggtgccaggctttgtggatttgaccctccatgatcaggtc

SEQ ID NO: 581 - DNA, 50 bp, Artificial Sequence; identical to SEQ ID NO: 580
  Description of Artificial Sequence: Synthetic oligonucleotide

SEQ ID NO: 582 - DNA, 50 bp, Artificial Sequence; identical to SEQ ID NO: 580
  Description of Artificial Sequence: Synthetic oligonucleotide

SEQ ID NO: 583 - DNA, 50 bp, Artificial Sequence; identical to SEQ ID NO: 580
  Description of Artificial Sequence: Synthetic oligonucleotide

SEQ ID NO: 584 - DNA, 50 bp, Artificial Sequence; identical to SEQ ID NO: 580
  Description of Artificial Sequence: Synthetic oligonucleotide

SEQ ID NO: 585 - DNA, 50 bp, Artificial Sequence; identical to SEQ ID NO: 580
  Description of Artificial Sequence: Synthetic oligonucleotide

SEQ ID NO: 586 - DNA, 50 bp, Artificial Sequence; identical to SEQ ID NO: 580
  Description of Artificial Sequence: Synthetic oligonucleotide

SEQ ID NO: 587 - DNA, 50 bp, Artificial Sequence; identical to SEQ ID NO: 580
  Description of Artificial Sequence: Synthetic oligonucleotide

SEQ ID NO: 588 - DNA, 50 bp, Artificial Sequence; identical to SEQ ID NO: 580
  Description of Artificial Sequence: Synthetic oligonucleotide

SEQ ID NO: 589 - DNA, 50 bp, Artificial Sequence; identical to SEQ ID NO: 580
  Description of Artificial Sequence: Synthetic oligonucleotide

SEQ ID NO: 590 - DNA, 50 bp, Artificial Sequence; identical to SEQ ID NO: 580
  Description of Artificial Sequence: Synthetic oligonucleotide

SEQ ID NO: 591 - DNA, 48 bp, Artificial Sequence
  Description of Artificial Sequence: Synthetic oligonucleotide
gggcgaagagggtgccaggctttgtggatttgaccctccatgatcagg

SEQ ID NO: 592 - DNA, 50 bp, Artificial Sequence; identical to SEQ ID NO: 580
  Description of Artificial Sequence: Synthetic oligonucleotide

SEQ ID NO: 593 - DNA, 50 bp, Artificial Sequence; identical to SEQ ID NO: 580
  Description of Artificial Sequence: Synthetic oligonucleotide

SEQ ID NO: 594 - DNA, 50 bp, Artificial Sequence
  Description of Artificial Sequence: Synthetic oligonucleotide
gggcgaagagggtgccaggctttgtggatttgacccgccatgatcaggtc

SEQ ID NO: 595 - DNA, 50 bp, Artificial Sequence; identical to SEQ ID NO: 580
  Description of Artificial Sequence: Synthetic oligonucleotide

SEQ ID NO: 596 - DNA, 50 bp, Artificial Sequence; identical to SEQ ID NO: 580
  Description of Artificial Sequence: Synthetic oligonucleotide

SEQ ID NO: 597 - DNA, 50 bp, Artificial Sequence
  Description of Artificial Sequence: Synthetic oligonucleotide
gggcgaagagggtgccaggctttgtggatttgaccttccatgatcaggtc

SEQ ID NO: 598 - DNA, 50 bp, Artificial Sequence; identical to SEQ ID NO: 580
  Description of Artificial Sequence: Synthetic oligonucleotide

SEQ ID NO: 599 - DNA, 50 bp, Artificial Sequence; identical to SEQ ID NO: 580
  Description of Artificial Sequence: Synthetic oligonucleotide

SEQ ID NO: 600 - DNA, 100 bp, Artificial Sequence
  Description of Artificial Sequence: Synthetic polynucleotide
tcaaggagccctaaacagccaggaggaagaagaagtcattgtcacagaggttggacagagagactctgaagatgtgagcaaaagagactccgataaagag

SEQ ID NO: 601 - DNA, 100 bp, Artificial Sequence
  Description of Artificial Sequence: Synthetic polynucleotide
ggcagacagggagctggttcacatgatcaactgggcgaagagggtgccaggtaagaatgcgaagcgcagcttttaagagtcaatagcttttcaagaactt

SEQ ID NO: 602 - DNA, 50 bp, Artificial Sequence
  Description of Artificial Sequence: Synthetic oligonucleotide
actgggcgaagagggtgccaggtaagaatgcgaagcgcagcttttaagag

SEQ ID NO: 603 - DNA, 50 bp, Artificial Sequence; identical to SEQ ID NO: 602
  Description of Artificial Sequence: Synthetic oligonucleotide

SEQ ID NO: 604 - DNA, 50 bp, Artificial Sequence
  Description of Artificial Sequence: Synthetic oligonucleotide
actgggcgaagagggtgccaggtaagaatgcgaagcgcggcttttaagag

SEQ ID NO: 605 - DNA, 50 bp, Artificial Sequence; identical to SEQ ID NO: 602
  Description of Artificial Sequence: Synthetic oligonucleotide

SEQ ID NO: 606 - DNA, 49 bp, Artificial Sequence
  Description of Artificial Sequence: Synthetic oligonucleotide
tgggcgaagagggtgccaggtaagaatgcgaagcgcagcttttaagagt

SEQ ID NO: 607 - DNA, 50 bp, Artificial Sequence
  Description of Artificial Sequence: Synthetic oligonucleotide
tgggcgaagagggtgccaggtaagaatgcgaagcgcagcttttaagagtc

SEQ ID NO: 608 - DNA, 50 bp, Artificial Sequence
  Description of Artificial Sequence: Synthetic oligonucleotide
gggcgaagagggtgccaggtaagaatgcgaagcgcagcttttaagagtca

SEQ ID NO: 609 - DNA, 50 bp, Artificial Sequence; identical to SEQ ID NO: 608
  Description of Artificial Sequence: Synthetic oligonucleotide

SEQ ID NO: 610 - DNA, 50 bp, Artificial Sequence; identical to SEQ ID NO: 608
  Description of Artificial Sequence: Synthetic oligonucleotide

SEQ ID NO: 611 - DNA, 50 bp, Artificial Sequence; identical to SEQ ID NO: 608
  Description of Artificial Sequence: Synthetic oligonucleotide

SEQ ID NO: 612 - DNA, 50 bp, Artificial Sequence; identical to SEQ ID NO: 608
  Description of Artificial Sequence: Synthetic oligonucleotide

SEQ ID NO: 613 - DNA, 50 bp, Artificial Sequence; identical to SEQ ID NO: 608
  Description of Artificial Sequence: Synthetic oligonucleotide

SEQ ID NO: 614 - DNA, 49 bp, Artificial Sequence
  Description of Artificial Sequence: Synthetic oligonucleotide
gggcgaagagggtgccaggtaagaatgcgaagcgcagcttttaagagtc

SEQ ID NO: 615 - DNA, 50 bp, Artificial Sequence; identical to SEQ ID NO: 608
  Description of Artificial Sequence: Synthetic oligonucleotide

SEQ ID NO: 616 - DNA, 50 bp, Artificial Sequence; identical to SEQ ID NO: 608
  Description of Artificial Sequence: Synthetic oligonucleotide

SEQ ID NO: 617 - DNA, 50 bp, Artificial Sequence
  Description of Artificial Sequence: Synthetic oligonucleotide
gggtgaagagggtgccaggtaagaatgcgaagcgcagcttttaagagtca

SEQ ID NO: 618 - DNA, 50 bp, Artificial Sequence
  Description of Artificial Sequence: Synthetic oligonucleotide
ggcgaagagggtgccaggtaagaatgcgaagcgcagcttttaagagtcaa

SEQ ID NO: 619 - DNA, 49 bp, Artificial Sequence
  Description of Artificial Sequence: Synthetic oligonucleotide
ggcgaagagggtgccaggtaagaatgcgaagcgcagcttttaagagtca

SEQ ID NO: 620 - DNA, 50 bp, Artificial Sequence
  Description of Artificial Sequence: Synthetic oligonucleotide
aagagggtgccaggtaagaatgcgaagcgcagcttttaagagtcaatagc

SEQ ID NO: 621 - DNA, 50 bp, Artificial Sequence; identical to SEQ ID NO: 620
  Description of Artificial Sequence: Synthetic oligonucleotide

SEQ ID NO: 622 - DNA, 50 bp, Artificial Sequence; identical to SEQ ID NO: 620
  Description of Artificial Sequence: Synthetic oligonucleotide

SEQ ID NO: 623 - DNA, 50 bp, Artificial Sequence; identical to SEQ ID NO: 620
  Description of Artificial Sequence: Synthetic oligonucleotide

SEQ ID NO: 624 - DNA, 50 bp, Artificial Sequence; identical to SEQ ID NO: 620
  Description of Artificial Sequence: Synthetic oligonucleotide

SEQ ID NO: 625 - DNA, 50 bp, Artificial Sequence; identical to SEQ ID NO: 620
  Description of Artificial Sequence: Synthetic oligonucleotide

SEQ ID NO: 626 - DNA, 50 bp, Artificial Sequence; identical to SEQ ID NO: 620
  Description of Artificial Sequence: Synthetic oligonucleotide

SEQ ID NO: 627 - DNA, 50 bp, Artificial Sequence
  Description of Artificial Sequence: Synthetic oligonucleotide
agagggtgccaggtaagaatgcgaagcgcagcctttaagagtcaatagct

SEQ ID NO: 628 - DNA, 50 bp, Artificial Sequence
  Description of Artificial Sequence: Synthetic oligonucleotide
agagggtgccaggtaagaatgcgaagcgcagcttttaggagtcaatagct

SEQ ID NO: 629 - DNA, 50 bp, Artificial Sequence
  Description of Artificial Sequence: Synthetic oligonucleotide
agagggtgccaggtaagaatgcgaagcgcagcttttaagagtcaatagct

SEQ ID NO: 630 - DNA, 50 bp, Artificial Sequence; identical to SEQ ID NO: 629
  Description of Artificial Sequence: Synthetic oligonucleotide

SEQ ID NO: 631 - DNA, 50 bp, Artificial Sequence; identical to SEQ ID NO: 629
  Description of Artificial Sequence: Synthetic oligonucleotide

SEQ ID NO: 632 - DNA, 49 bp, Artificial Sequence
  Description of Artificial Sequence: Synthetic oligonucleotide
agagggtgccaggtaagaatgcgaagcgcagcttttaagagtcaatagc

SEQ ID NO: 633 - DNA, 50 bp, Artificial Sequence
  Description of Artificial Sequence: Synthetic oligonucleotide
agagggtgccaggtaagaatgcgaagtgcagcttttaagagtcaatagct

SEQ ID NO: 634 - DNA, 50 bp, Artificial Sequence; identical to SEQ ID NO: 629
  Description of Artificial Sequence: Synthetic oligonucleotide

SEQ ID NO: 635 - DNA, 50 bp, Artificial Sequence; identical to SEQ ID NO: 629
  Description of Artificial Sequence: Synthetic oligonucleotide

SEQ ID NO: 636 - DNA, 50 bp, Artificial Sequence; identical to SEQ ID NO: 627
  Description of Artificial Sequence: Synthetic oligonucleotide

SEQ ID NO: 637 - DNA, 50 bp, Artificial Sequence
  Description of Artificial Sequence: Synthetic oligonucleotide
gagggtgccaggtaagaatgcgaagcgcagcttttaagagtcaatagctt

SEQ ID NO: 638 - DNA, 50 bp, Artificial Sequence; identical to SEQ ID NO: 637
  Description of Artificial Sequence: Synthetic oligonucleotide

SEQ ID NO: 639 - DNA, 50 bp, Artificial Sequence; identical to SEQ ID NO: 637
  Description of Artificial Sequence: Synthetic oligonucleotide

SEQ ID NO: 640 - DNA, 50 bp, Artificial Sequence; identical to SEQ ID NO: 637
  Description of Artificial Sequence: Synthetic oligonucleotide

SEQ ID NO: 641 - DNA, 50 bp, Artificial Sequence; identical to SEQ ID NO: 637
  Description of Artificial Sequence: Synthetic oligonucleotide

SEQ ID NO: 642 - DNA, 50 bp, Artificial Sequence
  Description of Artificial Sequence: Synthetic oligonucleotide
agggtgccaggtaagaatgcgaagcgcagcttttaagagttaatagcttt

SEQ ID NO: 643 - DNA, 50 bp, Artificial Sequence
  Description of Artificial Sequence: Synthetic oligonucleotide
  modified_base (4)..(4): a, c, t, g, unknown or other
aggntgccaggtaagaatgcgaagcgcagcttttaagagtcaatagcttt

SEQ ID NO: 644 - DNA, 50 bp, Artificial Sequence
  Description of Artificial Sequence: Synthetic oligonucleotide
agggtgccaggtaagaatgcgaagcgcagcttttaagagtcaatagcttt

SEQ ID NO: 645 - DNA, 50 bp, Artificial Sequence; identical to SEQ ID NO: 644
  Description of Artificial Sequence: Synthetic oligonucleotide

SEQ ID NO: 646 - DNA, 50 bp, Artificial Sequence; identical to SEQ ID NO: 644
  Description of Artificial Sequence: Synthetic oligonucleotide

SEQ ID NO: 647 - DNA, 50 bp, Artificial Sequence; identical to SEQ ID NO: 644
  Description of Artificial Sequence: Synthetic oligonucleotide

SEQ ID NO: 648 - DNA, 50 bp, Artificial Sequence; identical to SEQ ID NO: 644
  Description of Artificial Sequence: Synthetic oligonucleotide

SEQ ID NO: 649 - DNA, 50 bp, Artificial Sequence
  Description of Artificial Sequence: Synthetic oligonucleotide
agggtgccaggtaagaatgcgaggcgcagcttttaagagtcaatagcttt

SEQ ID NO: 650 - DNA, 50 bp, Artificial Sequence; identical to SEQ ID NO: 644
  Description of Artificial Sequence: Synthetic oligonucleotide

SEQ ID NO: 651 - DNA, 50 bp, Artificial Sequence
  Description of Artificial Sequence: Synthetic oligonucleotide
agggtgccaggtaagaatgcgaagcgtagcttttaagagtcaatagcttt

SEQ ID NO: 652 - DNA, 49 bp, Artificial Sequence
  Description of Artificial Sequence: Synthetic oligonucleotide
agggtgccaggtaagaatgcgaagcgcagcttttaagagtcaatagctt

SEQ ID NO: 653 - DNA, 50 bp, Artificial Sequence; identical to SEQ ID NO: 644
  Description of Artificial Sequence: Synthetic oligonucleotide

SEQ ID NO: 654 - DNA, 49 bp, Artificial Sequence
  Description of Artificial Sequence: Synthetic oligonucleotide
gggtgccaggtaagaatgcgaagcgcagcttttaagagtcaatagcttt

SEQ ID NO: 655 - DNA, 50 bp, Artificial Sequence
  Description of Artificial Sequence: Synthetic oligonucleotide
ggtgccaggtaagaatgcgaagcgcagcttttaagagtcaatagcttttc

SEQ ID NO: 656 - DNA, 50 bp, Artificial Sequence
  Description of Artificial Sequence: Synthetic oligonucleotide
ggtgccaggtaagaatgcgaagcgcagcttttaagagtcaatagtttttc

SEQ ID NO: 657 - DNA, 49 bp, Artificial Sequence
  Description of Artificial Sequence: Synthetic oligonucleotide
ggtgccaggtaagaatgcgaagcgcagcttttaagagtcaatagctttt

SEQ ID NO: 658 - DNA, 49 bp, Artificial Sequence; identical to SEQ ID NO: 657
  Description of Artificial Sequence: Synthetic oligonucleotide

SEQ ID NO: 659 - DNA, 50 bp, Artificial Sequence
  Description of Artificial Sequence: Synthetic oligonucleotide
gtgccaggtaagaatgcgaagcgcagcttttaagagtcaatagcttttca

SEQ ID NO: 660 - DNA, 50 bp, Artificial Sequence
  Description of Artificial Sequence: Synthetic oligonucleotide
gtgccaggtaagaatgcgaagcgcagcttttaagagccaatagcttttca

SEQ ID NO: 661 - DNA, 50 bp, Artificial Sequence; identical to SEQ ID NO: 659
  Description of Artificial Sequence: Synthetic oligonucleotide

SEQ ID NO: 662 - DNA, 50 bp, Artificial Sequence; identical to SEQ ID NO: 659
  Description of Artificial Sequence: Synthetic oligonucleotide

SEQ ID NO: 663 - DNA, 50 bp, Artificial Sequence
  Description of Artificial Sequence: Synthetic oligonucleotide
gtgccaggtaagaatgcgaagcgcagcttttaagagtcaatagcttctca

SEQ ID NO: 664 - DNA, 50 bp, Artificial Sequence; identical to SEQ ID NO: 659
  Description of Artificial Sequence: Synthetic oligonucleotide

SEQ ID NO: 665 - DNA, 50 bp, Artificial Sequence; identical to SEQ ID NO: 659
  Description of Artificial Sequence: Synthetic oligonucleotide

SEQ ID NO: 666 - DNA, 50 bp, Artificial Sequence; identical to SEQ ID NO: 659
  Description of Artificial Sequence: Synthetic oligonucleotide

SEQ ID NO: 667 - DNA, 50 bp, Artificial Sequence
  Description of Artificial Sequence: Synthetic oligonucleotide
gtgccaggtaagaatgcgaagcgcagcttttaagagacaatagcttttca

SEQ ID NO: 668 - DNA, 50 bp, Artificial Sequence
  Description of Artificial Sequence: Synthetic oligonucleotide
tgccaggtaagaatgcgaagcgcagcttttaagagtcaatagcttttcaa

SEQ ID NO: 669 - DNA, 50 bp, Artificial Sequence; identical to SEQ ID NO: 668
  Description of Artificial Sequence: Synthetic oligonucleotide

SEQ ID NO: 670 - DNA, 50 bp, Artificial Sequence; identical to SEQ ID NO: 668
  Description of Artificial Sequence: Synthetic oligonucleotide

SEQ ID NO: 671 - DNA, 50 bp, Artificial Sequence
  Description of Artificial Sequence: Synthetic oligonucleotide
tgccaggtaagaatgtgaagcgcagcttttaagagtcaatagcttttcaa

SEQ ID NO: 672 - DNA, 50 bp, Artificial Sequence; identical to SEQ ID NO: 668
  Description of Artificial Sequence: Synthetic oligonucleotide

SEQ ID NO: 673 - DNA, 50 bp, Artificial Sequence
  Description of Artificial Sequence: Synthetic oligonucleotide
tgccaggtaagaatgcgaagcgcagcttttaagagttaatagcttttcaa

SEQ ID NO: 674 - DNA, 50 bp, Artificial Sequence; identical to SEQ ID NO: 668
  Description of Artificial Sequence: Synthetic oligonucleotide

SEQ ID NO: 675 - DNA, 49 bp, Artificial Sequence
  Description of Artificial Sequence: Synthetic oligonucleotide
tgccaggtaagaatgcgaagcgcagcttttaagagtcaatagcttttca

SEQ ID NO: 676 - DNA, 50 bp, Artificial Sequence
  Description of Artificial Sequence: Synthetic oligonucleotide
tgccaggtaaggatgcgaagcgcagcttttaagagtcaatagcttttcaa

SEQ ID NO: 677 - DNA, 50 bp, Artificial Sequence
  Description of Artificial Sequence: Synthetic oligonucleotide
tgccaggtaagaatgcgaagtgcagcttttaagagtcaatagcttttcaa

SEQ ID NO: 678 - DNA, 50 bp, Artificial Sequence
  Description of Artificial Sequence: Synthetic oligonucleotide
gccaggtaagaatgcgaagcgcagcttttaagagtcaatagcttttcaag

SEQ ID NO: 679 - DNA, 50 bp, Artificial Sequence; identical to SEQ ID NO: 678
  Description of Artificial Sequence: Synthetic oligonucleotide

SEQ ID NO: 680 - DNA, 50 bp, Artificial Sequence; identical to SEQ ID NO: 678
  Description of Artificial Sequence: Synthetic oligonucleotide

SEQ ID NO: 681 - DNA, 50 bp, Artificial Sequence; identical to SEQ ID NO: 678
  Description of Artificial Sequence: Synthetic oligonucleotide

SEQ ID NO: 682 - DNA, 50 bp, Artificial Sequence; identical to SEQ ID NO: 678
  Description of Artificial Sequence: Synthetic oligonucleotide

SEQ ID NO: 683 - DNA, 50 bp, Artificial Sequence; identical to SEQ ID NO: 678
  Description of Artificial Sequence: Synthetic oligonucleotide

SEQ ID NO: 684 - DNA, 50 bp, Artificial Sequence; identical to SEQ ID NO: 678
  Description of Artificial Sequence: Synthetic oligonucleotide

SEQ ID NO: 685 - DNA, 50 bp, Artificial Sequence; identical to SEQ ID NO: 678
  Description of Artificial Sequence: Synthetic oligonucleotide

SEQ ID NO: 686 - DNA, 49 bp, Artificial Sequence
  Description of Artificial Sequence: Synthetic oligonucleotide
gccaggtaagaatgcgaagcgcagcttttaagagtcaatagcttttcaa

SEQ ID NO: 687 - DNA, 49 bp, Artificial Sequence; identical to SEQ ID NO: 686
  Description of Artificial Sequence: Synthetic oligonucleotide

SEQ ID NO: 688 - DNA, 50 bp, Artificial Sequence; identical to SEQ ID NO: 678
  Description of Artificial Sequence: Synthetic oligonucleotide

SEQ ID NO: 689 - DNA, 50 bp, Artificial Sequence; identical to SEQ ID NO: 678
  Description of Artificial Sequence: Synthetic oligonucleotide

SEQ ID NO: 690 - DNA, 49 bp, Artificial Sequence; identical to SEQ ID NO: 686
  Description of Artificial Sequence: Synthetic oligonucleotide

SEQ ID NO: 691 - DNA, 50 bp, Artificial Sequence; identical to SEQ ID NO: 678
  Description of Artificial Sequence: Synthetic oligonucleotide

SEQ ID NO: 692 - DNA, 50 bp, Artificial Sequence; identical to SEQ ID NO: 678
  Description of Artificial Sequence: Synthetic oligonucleotide

SEQ ID NO: 693 - DNA, 50 bp, Artificial Sequence; identical to SEQ ID NO: 678
  Description of Artificial Sequence: Synthetic oligonucleotide

SEQ ID NO: 694 - DNA, 50 bp, Artificial Sequence; identical to SEQ ID NO: 678
  Description of Artificial Sequence: Synthetic oligonucleotide

SEQ ID NO: 695 - DNA, 50 bp, Artificial Sequence; identical to SEQ ID NO: 678
  Description of Artificial Sequence: Synthetic oligonucleotide

SEQ ID NO: 696 - DNA, 49 bp, Artificial Sequence; identical to SEQ ID NO: 686
  Description of Artificial Sequence: Synthetic oligonucleotide

SEQ ID NO: 697 - DNA, 50 bp, Artificial Sequence; identical to SEQ ID NO: 678
  Description of Artificial Sequence: Synthetic oligonucleotide

SEQ ID NO: 698 - DNA, 50 bp, Artificial Sequence; identical to SEQ ID NO: 678
  Description of Artificial Sequence: Synthetic oligonucleotide

SEQ ID NO: 699 - DNA, 50 bp, Artificial Sequence; identical to SEQ ID NO: 678
  Description of Artificial Sequence: Synthetic oligonucleotide

SEQ ID NO: 700 - DNA, 50 bp, Artificial Sequence; identical to SEQ ID NO: 678
  Description of Artificial Sequence: Synthetic oligonucleotide

SEQ ID NO: 701 - DNA, 50 bp, Artificial Sequence; identical to SEQ ID NO: 678
  Description of Artificial Sequence: Synthetic oligonucleotide

SEQ ID NO: 702 - DNA, 50 bp, Artificial Sequence; identical to SEQ ID NO: 678
  Description of Artificial Sequence: Synthetic oligonucleotide

SEQ ID NO: 703 - DNA, 50 bp, Artificial Sequence; identical to SEQ ID NO: 678
  Description of Artificial Sequence: Synthetic oligonucleotide

SEQ ID NO: 704 - DNA, 50 bp, Artificial Sequence
  Description of Artificial Sequence: Synthetic oligonucleotide
gccaggtaagaatgcgaagcgtagcttttaagagtcaatagcttttcaag

SEQ ID NO: 705 - DNA, 50 bp, Artificial Sequence; identical to SEQ ID NO: 678
  Description of Artificial Sequence: Synthetic oligonucleotide

SEQ ID NO: 706 - DNA, 50 bp, Artificial Sequence; identical to SEQ ID NO: 678
  Description of Artificial Sequence: Synthetic oligonucleotide

SEQ ID NO: 707 - DNA, 50 bp, Artificial Sequence
  Description of Artificial Sequence: Synthetic oligonucleotide
gccaggtaagaatgcgaagcgcagcttttaagagtcaatagtttttcaag

SEQ ID NO: 708 - DNA, 50 bp, Artificial Sequence
  Description of Artificial Sequence: Synthetic oligonucleotide
gccaggtaagaatgcgaagcgcagcttttaagagttaatagcttttcaag

SEQ ID NO: 709 - DNA, 50 bp, Artificial Sequence
  Description of Artificial Sequence: Synthetic oligonucleotide
gccaggtaagaatgtgaagcgcagcttttaagagtcaatagcttttcaag

SEQ ID NO: 710 - DNA, 50 bp, Artificial Sequence; identical to SEQ ID NO: 678
  Description of Artificial Sequence: Synthetic oligonucleotide

SEQ ID NO: 711 - DNA, 50 bp, Artificial Sequence; identical to SEQ ID NO: 704
  Description of Artificial Sequence: Synthetic oligonucleotide

SEQ ID NO: 712 - DNA, 50 bp, Artificial Sequence; identical to SEQ ID NO: 678
  Description of Artificial Sequence: Synthetic oligonucleotide

SEQ ID NO: 713 - DNA, 50 bp, Artificial Sequence; identical to SEQ ID NO: 707
  Description of Artificial Sequence: Synthetic oligonucleotide

SEQ ID NO: 714 - DNA, 50 bp, Artificial Sequence; identical to SEQ ID NO: 678
  Description of Artificial Sequence: Synthetic oligonucleotide

SEQ ID NO: 715 - DNA, 50 bp, Artificial Sequence; identical to SEQ ID NO: 678
  Description of Artificial Sequence: Synthetic oligonucleotide

SEQ ID NO: 716 - DNA, 49 bp, Artificial Sequence; identical to SEQ ID NO: 686
  Description of Artificial Sequence: Synthetic oligonucleotide

SEQ ID NO: 717 - DNA, 50 bp, Artificial Sequence; identical to SEQ ID NO: 678
  Description of Artificial Sequence: Synthetic oligonucleotide

SEQ ID NO: 718 - DNA, 50 bp, Artificial Sequence; identical to SEQ ID NO: 678
  Description of Artificial Sequence: Synthetic oligonucleotide

SEQ ID NO: 719 - DNA, 50 bp, Artificial Sequence; identical to SEQ ID NO: 678
  Description of Artificial Sequence: Synthetic oligonucleotide

SEQ ID NO: 720 - DNA, 50 bp, Artificial Sequence; identical to SEQ ID NO: 678
  Description of Artificial Sequence: Synthetic oligonucleotide

SEQ ID NO: 721 - DNA, 50 bp, Artificial Sequence; identical to SEQ ID NO: 707
  Description of Artificial Sequence: Synthetic oligonucleotide

SEQ ID NO: 722 - DNA, 50 bp, Artificial Sequence; identical to SEQ ID NO: 678
  Description of Artificial Sequence: Synthetic oligonucleotide

SEQ ID NO: 723 - DNA, 50 bp, Artificial Sequence; identical to SEQ ID NO: 678
  Description of Artificial Sequence: Synthetic oligonucleotide

SEQ ID NO: 724 - DNA, 50 bp, Artificial Sequence; identical to SEQ ID NO: 678
  Description of Artificial Sequence: Synthetic oligonucleotide

SEQ ID NO: 725 - DNA, 50 bp, Artificial Sequence; identical to SEQ ID NO: 678
  Description of Artificial Sequence: Synthetic oligonucleotide

SEQ ID NO: 726 - DNA, 50 bp, Artificial Sequence; identical to SEQ ID NO: 708
  Description of Artificial Sequence: Synthetic oligonucleotide

SEQ ID NO: 727 - DNA, 49 bp, Artificial Sequence; identical to SEQ ID NO: 686
  Description of Artificial Sequence: Synthetic oligonucleotide

SEQ ID NO: 728 - DNA, 100 bp, Artificial Sequence
  Description of Artificial Sequence: Synthetic polynucleotide
gtaatcaccttttctcttctccccacccccccgcccctttttgttaatagttggacagagagactctgaagatgtgagcaaaagagactccgataaagag

SEQ ID NO: 729 - DNA, 100 bp, Artificial Sequence
  Description of Artificial Sequence: Synthetic polynucleotide
cctcgcttgtcttctcgggcttctcgccccggccgcggccgggtcctcagacttaattcagtgcacaaatgagatgaatgtgaacatcccacagttggca

SEQ ID NO: 730 - DNA, 50 bp, Artificial Sequence
  Description of Artificial Sequence: Synthetic oligonucleotide
gccgcggccgggtcctcagacttaattcagtgcacaaatgagatgaatgt

SEQ ID NO: 731 - DNA, 50 bp, Artificial Sequence; identical to SEQ ID NO: 730
  Description of Artificial Sequence: Synthetic oligonucleotide

SEQ ID NO: 732 - DNA, 100 bp, Artificial Sequence
  Description of Artificial Sequence: Synthetic polynucleotide
cctcgcttgtcttctcgggcttctcgccccggccgcggccgggtcctcagtagtcgagaatgactaaaaaaagaaaacgccaacatgattttcaaaaagt

SEQ ID NO: 733 - DNA, 100 bp, Artificial Sequence
  Description of Artificial Sequence: Synthetic polynucleotide
caaggccacgacccacgagatcatggggcccaagaaaaagcacctggactacttaattcagtgcacaaatgagatgaatgtgaacatcccacagttggca

SEQ ID NO: 734 - DNA, 49 bp, Artificial Sequence
  Description of Artificial Sequence: Synthetic oligonucleotide
cacgagatcatggggcccaagaaaaagcacctggactacttaattcagt

SEQ ID NO: 735 - DNA, 49 bp, Artificial Sequence; identical to SEQ ID NO: 734
  Description of Artificial Sequence: Synthetic oligonucleotide

SEQ ID NO: 736 - DNA, 50 bp, Artificial Sequence
  Description of Artificial Sequence: Synthetic oligonucleotide
tcatggggtccaagaaaaagcacctggactacttaattcagtgcacaaat

SEQ ID NO: 737 - DNA, 50 bp, Artificial Sequence; identical to SEQ ID NO: 736
  Description of Artificial Sequence: Synthetic oligonucleotide

SEQ ID NO: 738 - DNA, 50 bp, Artificial Sequence
  Description of Artificial Sequence: Synthetic oligonucleotide
tggggcccaagaaaaagcacctggactacttaattcagtgcacaaatgag

SEQ ID NO: 739 - DNA, 50 bp, Artificial Sequence
  Description of Artificial Sequence: Synthetic oligonucleotide
ggggcccaagaaaaagcacctggactacttaattcagtgcacaaatgaga

SEQ ID NO: 740 - DNA, 50 bp, Artificial Sequence; identical to SEQ ID NO: 739
  Description of Artificial Sequence: Synthetic oligonucleotide

SEQ ID NO: 741 - DNA, 50 bp, Artificial Sequence
  Description of Artificial Sequence: Synthetic oligonucleotide
gggcccaagaaaaagcacctggactacttaattcagtgcacaaatgagat

SEQ ID NO: 742 - DNA, 50 bp, Artificial Sequence
  Description of Artificial Sequence: Synthetic oligonucleotide
aaagcacctggactacttaattcagtgcacaaatgagatgaatgtgaaca

SEQ ID NO: 743 - DNA, 50 bp, Artificial Sequence
  Description of Artificial Sequence: Synthetic oligonucleotide
aagcacctggactacttaattcagtgcacaaatgagatgaatgtgaacat

SEQ ID NO: 744 - DNA, 50 bp, Artificial Sequence
  Description of Artificial Sequence: Synthetic oligonucleotide
ggactacttaattcagtgcacaaatgagatgaatgtgaacatcccacagt

SEQ ID NO: 745 - DNA, 50 bp, Artificial Sequence; identical to SEQ ID NO: 744
  Description of Artificial Sequence: Synthetic oligonucleotide

SEQ ID NO: 746 - DNA, 50 bp, Artificial Sequence; identical to SEQ ID NO: 744
  Description of Artificial Sequence: Synthetic oligonucleotide

SEQ ID NO: 747 - DNA, 50 bp, Artificial Sequence; identical to SEQ ID NO: 744
  Description of Artificial Sequence: Synthetic oligonucleotide

SEQ ID NO: 748 - DNA, 50 bp, Artificial Sequence; identical to SEQ ID NO: 744
  Description of Artificial Sequence: Synthetic oligonucleotide

SEQ ID NO: 749 - DNA, 50 bp, Artificial Sequence; identical to SEQ ID NO: 744
  Description of Artificial Sequence: Synthetic oligonucleotide

SEQ ID NO: 750 - DNA, 50 bp, Artificial Sequence; identical to SEQ ID NO: 744
  Description of Artificial Sequence: Synthetic oligonucleotide

SEQ ID NO: 751 - DNA, 50 bp, Artificial Sequence; identical to SEQ ID NO: 744
  Description of Artificial Sequence: Synthetic oligonucleotide

SEQ ID NO: 752 - DNA, 50 bp, Artificial Sequence
  Description of Artificial Sequence: Synthetic oligonucleotide
ggactacttaattcagtgcacaaatgagatgaatgtgtacatcccacagt

SEQ ID NO: 753 - DNA, 50 bp, Artificial Sequence; identical to SEQ ID NO: 744
  Description of Artificial Sequence: Synthetic oligonucleotide

SEQ ID NO: 754 - DNA, 50 bp, Artificial Sequence; identical to SEQ ID NO: 744
  Description of Artificial Sequence: Synthetic oligonucleotide

SEQ ID NO: 755 - DNA, 50 bp, Artificial Sequence; identical to SEQ ID NO: 744
  Description of Artificial Sequence: Synthetic oligonucleotide

SEQ ID NO: 756 - DNA, 50 bp, Artificial Sequence; identical to SEQ ID NO: 744
  Description of Artificial Sequence: Synthetic oligonucleotide

SEQ ID NO: 757 - DNA, 50 bp, Artificial Sequence; identical to SEQ ID NO: 744
  Description of Artificial Sequence: Synthetic oligonucleotide

SEQ ID NO: 758 - DNA, 50 bp, Artificial Sequence; identical to SEQ ID NO: 744
  Description of Artificial Sequence: Synthetic oligonucleotide

SEQ ID NO: 759 - DNA, 50 bp, Artificial Sequence; identical to SEQ ID NO: 744
  Description of Artificial Sequence: Synthetic oligonucleotide

SEQ ID NO: 760 - DNA, 100 bp, Artificial Sequence
  Description of Artificial Sequence: Synthetic polynucleotide
cctcgcttgtcttctcgggcttctcgccccggccgcggccgggtcctcaggtaagcggccgtcgcccgtcgggccgggtcctcccggggcgcgggactga

SEQ ID NO: 761 - DNA, 100 bp, Artificial Sequence
  Description of Artificial Sequence: Synthetic polynucleotide
taaattaaaaccacagaggaaattaatcatttaaaaattttttattgcagacttaattcagtgcacaaatgagatgaatgtgaacatcccacagttggca

SEQ ID NO: 762 - DNA, 50 bp, Artificial Sequence
  Description of Artificial Sequence: Synthetic oligonucleotide
tattgcagacttaattcagtgcacaaatgagatgaatgtgaacagcccac

SEQ ID NO: 763 - DNA, 100 bp, Artificial Sequence
  Description of Artificial Sequence: Synthetic polynucleotide
ccattttatttgcaaaagtggtgcgcataggcaagtcatttatgaaggaggaaaaggccaaagttgttgagcccctggactatgagaatgttattgccca

SEQ ID NO: 764 - DNA, 49 bp, Artificial Sequence
  Description of Artificial Sequence: Synthetic oligonucleotide
gcgcataggcaagtcatttatgaaggaggaaaaggccaaagttgttgag

SEQ ID NO: 765 - DNA, 100 bp, Artificial Sequence
  Description of Artificial Sequence: Synthetic polynucleotide
ccattttatttgcaaaagtggtgcgcataggcaagtcatttatgaaggagtttcagtctgatggaagcaaacaagaagataaagaaaaaacggaagttat

SEQ ID NO: 766 - DNA, 50 bp, Artificial Sequence
  Description of Artificial Sequence: Synthetic oligonucleotide
gtggtgcgcataggcaagtcatttatgaaggagtttcagtctgatggaag

SEQ ID NO: 767 - DNA, 50 bp, Artificial Sequence
  Description of Artificial Sequence: Synthetic oligonucleotide
ggtgcgcataggcaagtcatttatgaaggagtttcagtctgatggaagca

SEQ ID NO: 768 - DNA, 50 bp, Artificial Sequence; identical to SEQ ID NO: 767
  Description of Artificial Sequence: Synthetic oligonucleotide

SEQ ID NO: 769 - DNA, 50 bp, Artificial Sequence
  Description of Artificial Sequence: Synthetic oligonucleotide
gcgcataggcaagtcatttatgaaggagtttcagtctgatggaagcaaac

SEQ ID NO: 770 - DNA, 50 bp, Artificial Sequence; identical to SEQ ID NO: 769
  Description of Artificial Sequence: Synthetic oligonucleotide

SEQ ID NO: 771 - DNA, 50 bp, Artificial Sequence; identical to SEQ ID NO: 769
  Description of Artificial Sequence: Synthetic oligonucleotide

SEQ ID NO: 772 - DNA, 50 bp, Artificial Sequence; identical to SEQ ID NO: 769
  Description of Artificial Sequence: Synthetic oligonucleotide

SEQ ID NO: 773 - DNA, 50 bp, Artificial Sequence
  Description of Artificial Sequence: Synthetic oligonucleotide
gcataggcaagtcatttatgaaggagtttcagtctgatggaagcaaacaa

SEQ ID NO: 774 - DNA, 50 bp, Artificial Sequence
  Description of Artificial Sequence: Synthetic oligonucleotide
cataggcaagtcatttatgaaggagtttcagtctgatggaagcaaacaag

SEQ ID NO: 775 - DNA, 50 bp, Artificial Sequence
  Description of Artificial Sequence: Synthetic oligonucleotide
taggcaagtcatttatgaaggagtttcagtctgatggaagcaaacaagaa

SEQ ID NO: 776 - DNA, 50 bp, Artificial Sequence; identical to SEQ ID NO: 775
  Description of Artificial Sequence: Synthetic oligonucleotide

SEQ ID NO: 777 - DNA, 50 bp, Artificial Sequence
  Description of Artificial Sequence: Synthetic oligonucleotide
aggcaagtcatttatgaaggagtttcagtctgatggaagcaaacaagaag

SEQ ID NO: 778 - DNA, 50 bp, Artificial Sequence; identical to SEQ ID NO: 777
  Description of Artificial Sequence: Synthetic oligonucleotide

SEQ ID NO: 779 - DNA, 50 bp, Artificial Sequence; identical to SEQ ID NO: 777
  Description of Artificial Sequence: Synthetic oligonucleotide

SEQ ID NO: 780 - DNA, 50 bp, Artificial Sequence; identical to SEQ ID NO: 777
  Description of Artificial Sequence: Synthetic oligonucleotide

SEQ ID NO: 781 - DNA, 50 bp, Artificial Sequence; identical to SEQ ID NO: 777
  Description of Artificial Sequence: Synthetic oligonucleotide

SEQ ID NO: 782 - DNA, 50 bp, Artificial Sequence; identical to SEQ ID NO: 777
  Description of Artificial Sequence: Synthetic oligonucleotide

SEQ ID NO: 783 - DNA, 50 bp, Artificial Sequence; identical to SEQ ID NO: 777
  Description of Artificial Sequence: Synthetic oligonucleotide

SEQ ID NO: 784 - DNA, 100 bp, Artificial Sequence
  Description of Artificial Sequence: Synthetic polynucleotide
ctgagctccggcagagcgtgtctgaggccgtgcggggctccgtggtgctggaaaaggccaaagttgttgagcccctggactatgagaatgttattgccca

SEQ ID NO: 785 - DNA, 100 bp, Artificial Sequence
  Description of Artificial Sequence: Synthetic polynucleotide
ccattttatttgcaaaagtggtgcgcataggcaagtcatttatgaaggaggtaagtaagatttttcttacaaacctaaattttgaaatgaaaatattctg

SEQ ID NO: 786 - DNA, 100 bp, Artificial Sequence
  Description of Artificial Sequence: Synthetic polynucleotide
taactcttgtgagtttgatcataataactttacttttgtctcttataaaggaaaaggccaaagttgttgagcccctggactatgagaatgttattgccca

SEQ ID NO: 787 - DNA, 100 bp, Artificial Sequence
  Description of Artificial Sequence: Synthetic polynucleotide
tacgctctaaagattgagacttccgagtcctgcctgatgctgtctgcgagccctcttcggaaacgtcgtaaaagaaagaagaaagaagaagaaatggaaa

SEQ ID NO: 788 - DNA, 50 bp, Artificial Sequence
  Description of Artificial Sequence: Synthetic oligonucleotide
gcctgatgctgtctgcgagccctcttcggaaacgtcgtaaaagaaagaag

SEQ ID NO: 789 - DNA, 50 bp, Artificial Sequence; identical to SEQ ID NO: 788
  Description of Artificial Sequence: Synthetic oligonucleotide

SEQ ID NO: 790 - DNA, 50 bp, Artificial Sequence; identical to SEQ ID NO: 788
  Description of Artificial Sequence: Synthetic oligonucleotide

SEQ ID NO: 791 - DNA, 50 bp, Artificial Sequence; identical to SEQ ID NO: 788
  Description of Artificial Sequence: Synthetic oligonucleotide

SEQ ID NO: 792 - DNA, 100 bp, Artificial Sequence
  Description of Artificial Sequence: Synthetic polynucleotide
tacgctctaaagattgagacttccgagtcctgcctgatgctgtctgcgagctcctgtgcagagagggacgagtggtatggctgtctgagcagagccctcc

SEQ ID NO: 793 - DNA, 100 bp, Artificial Sequence
  Description of Artificial Sequence: Synthetic polynucleotide
gttatggtagtttttattattttggtcatcggtgtctgcacatgctgtcaccctcttcggaaacgtcgtaaaagaaagaagaaagaagaagaaatggaaa

SEQ ID NO: 794 - DNA, 100 bp, Artificial Sequence
  Description of Artificial Sequence: Synthetic polynucleotide
tacgctctaaagattgagacttccgagtcctgcctgatgctgtctgcgaggtacgggcaggtggagggaggatggcgcacaaggcagaggtgtgagcatg

SEQ ID NO: 795 - DNA, 100 bp, Artificial Sequence
  Description of Artificial Sequence: Synthetic polynucleotide
ttcgcatgaactactaggcccatactaacttctaacacgtattttccaagccctcttcggaaacgtcgtaaaagaaagaagaaagaagaagaaatggaaa

SEQ ID NO: 796 - DNA, 100 bp, Artificial Sequence
  Description of Artificial Sequence: Synthetic polynucleotide
gggtcaccaaggtcctgggcaggaccggttctcagggacagtgcacgcagggttcttctgctcactgggtcagaagcatccgatttcctgtcatcggttg

SEQ ID NO: 797 - DNA, 50 bp, Artificial Sequence
  Description of Artificial Sequence: Synthetic oligonucleotide
gggcaggaccggttctcagggacagtgcacgcagggttcttctgctcact

SEQ ID NO: 798 - DNA, 50 bp, Artificial Sequence
  Description of Artificial Sequence: Synthetic oligonucleotide
agggacagtgcacgcagggttcttctgctcaccgggtcagaagcatccga

SEQ ID NO: 799 - DNA, 100 bp, Artificial Sequence
  Description of Artificial Sequence: Synthetic polynucleotide
gggtcaccaaggtcctgggcaggaccggttctcagggacagtgcacgcaggtgcgcgtggaattcatggacgacacgagccgatccatcatccgcaatgt

SEQ ID NO: 800 - DNA, 100 bp, Artificial Sequence
  Description of Artificial Sequence: Synthetic polynucleotide
acgcatgcataatataccataaggcagcataactgatagtggaccttaagggttcttctgctcactgggtcagaagcatccgatttcctgtcatcggttg

SEQ ID NO: 801 - DNA, 100 bp, Artificial Sequence
  Description of Artificial Sequence: Synthetic polynucleotide
aggtcaccaaggtcctgggcaggaccggttctcagggacagtgcacgcaggtaatcgggtgggggcatttggccgactgccggcgacctaaaccctgatg

SEQ ID NO: 802 - DNA, 50 bp, Artificial Sequence
  Description of Artificial Sequence: Synthetic oligonucleotide
cagtgcacgcaggtaatcgggtgggggcatttggccgactgccggcgacc

SEQ ID NO: 803 - DNA, 50 bp, Artificial Sequence; identical to SEQ ID NO: 802
  Description of Artificial Sequence: Synthetic oligonucleotide

SEQ ID NO: 804 - DNA, 100 bp, Artificial Sequence
  Description of Artificial Sequence: Synthetic polynucleotide
gtatgttttatatttttagccctttgaaaaaaatgtcatccttttcccagggttcttctgctcactgggtcagaagcatccgatttcctgtcatcggttg

SEQ ID NO: 805 - DNA, 100 bp, Artificial Sequence
  Description of Artificial Sequence: Synthetic polynucleotide
caagatgctgcttactggtgggaaatcaagtcgtaaaaacaggtcaagtgaaagtggtaaaatagctgtggagtacagacccagtgaagacatcgtaggt

SEQ ID NO: 806 - DNA, 50 bp, Artificial Sequence
  Description of Artificial Sequence: Synthetic oligonucleotide
tactggtgggaaatcaagtcgtaaaaacaggtcaagtgaaagtggtaaaa

SEQ ID NO: 807 - DNA, 50 bp, Artificial Sequence; identical to SEQ ID NO: 806
  Description of Artificial Sequence: Synthetic oligonucleotide

SEQ ID NO: 808 - DNA, 50 bp, Artificial Sequence; identical to SEQ ID NO: 806
  Description of Artificial Sequence: Synthetic oligonucleotide

SEQ ID NO: 809 - DNA, 50 bp, Artificial Sequence
  Description of Artificial Sequence: Synthetic oligonucleotide
ggtgggaaatcaagtcgtaaaaacaggtcaagtgaaagtggtaaaatagc

SEQ ID NO: 810 - DNA, 50 bp, Artificial Sequence
  Description of Artificial Sequence: Synthetic oligonucleotide
gggaaatcaagtcgtaaaaataggtcaagtgaaagtggtaaaatagctgt

SEQ ID NO: 811 - DNA, 100 bp, Artificial Sequence
  Description of Artificial Sequence: Synthetic polynucleotide
caagatgctgcttactggtgggaaatcaagtcgtaaaaacaggtcaagtgatggagggagcgaggaaccaccggatcgaagacagtcaagtgtagactct

SEQ ID NO: 812 - DNA, 50 bp, Artificial Sequence
  Description of Artificial Sequence: Synthetic oligonucleotide
ggtgggaaatcaagtcgtaaaaacaggtcaagtgatggagggagcgagga

SEQ ID NO: 813 - DNA, 50 bp, Artificial Sequence; identical to SEQ ID NO: 812
  Description of Artificial Sequence: Synthetic oligonucleotide

SEQ ID NO: 814 - DNA, 50 bp, Artificial Sequence; identical to SEQ ID NO: 812
  Description of Artificial Sequence: Synthetic oligonucleotide

SEQ ID NO: 815 - DNA, 50 bp, Artificial Sequence; identical to SEQ ID NO: 812
  Description of Artificial Sequence: Synthetic oligonucleotide

SEQ ID NO: 816 - DNA, 49 bp, Artificial Sequence
  Description of Artificial Sequence: Synthetic oligonucleotide
tgggaaatcaagtcgtaaaaacaggtcaagtgatggagggagcgaggaa

SEQ ID NO: 817 - DNA, 49 bp, Artificial Sequence; identical to SEQ ID NO: 816
  Description of Artificial Sequence: Synthetic oligonucleotide

SEQ ID NO: 818 - DNA, 49 bp, Artificial Sequence; identical to SEQ ID NO: 816
  Description of Artificial Sequence: Synthetic oligonucleotide

SEQ ID NO: 819 - DNA, 49 bp, Artificial Sequence; identical to SEQ ID NO: 816
  Description of Artificial Sequence: Synthetic oligonucleotide

SEQ ID NO: 820 - DNA, 49 bp, Artificial Sequence; identical to SEQ ID NO: 816
  Description of Artificial Sequence: Synthetic oligonucleotide

SEQ ID NO: 821 - DNA, 49 bp, Artificial Sequence; identical to SEQ ID NO: 816
  Description of Artificial Sequence: Synthetic oligonucleotide

SEQ ID NO: 822 - DNA, 100 bp, Artificial Sequence
  Description of Artificial Sequence: Synthetic polynucleotide
tcagaaggctttgtcagatgcattccagaaactgttgattgttgttctagaaagtggtaaaatagctgtggagtacagacccagtgaagacatcgtaggt

SEQ ID NO: 823 - DNA, 100 bp, Artificial Sequence
  Description of Artificial Sequence: Synthetic polynucleotide
caagatgctgcttactggtgggaaatcaagtcgtaaaaacaggtcaagtggtaagtgactatgctacatttattgtgcgtgatattttacaaatacaagt

SEQ ID NO: 824 - DNA, 50 bp, Artificial Sequence
  Description of Artificial Sequence: Synthetic oligonucleotide
ggtgggaaatcaagtcgtaaaaacaggtcaagtggtaagtgactatgcta

SEQ ID NO: 825 - DNA, 50 bp, Artificial Sequence; identical to SEQ ID NO: 824
  Description of Artificial Sequence: Synthetic oligonucleotide

SEQ ID NO: 826 - DNA, 50 bp, Artificial Sequence
  Description of Artificial Sequence: Synthetic oligonucleotide
gggaaatcaagtcgtaaaaacaggtcaagtggtaagtgactatgctacat

SEQ ID NO: 827 - DNA, 50 bp, Artificial Sequence; identical to SEQ ID NO: 826
  Description of Artificial Sequence: Synthetic oligonucleotide

SEQ ID NO: 828 - DNA, 50 bp, Artificial Sequence; identical to SEQ ID NO: 826
  Description of Artificial Sequence: Synthetic oligonucleotide

SEQ ID NO: 829 - DNA, 50 bp, Artificial Sequence; identical to SEQ ID NO: 826
  Description of Artificial Sequence: Synthetic oligonucleotide

SEQ ID NO: 830 - DNA, 50 bp, Artificial Sequence; identical to SEQ ID NO: 826
  Description of Artificial Sequence: Synthetic oligonucleotide

SEQ ID NO: 831 - DNA, 50 bp, Artificial Sequence; identical to SEQ ID NO: 826
  Description of Artificial Sequence: Synthetic oligonucleotide

SEQ ID NO: 832 - DNA, 100 bp, Artificial Sequence
  Description of Artificial Sequence: Synthetic polynucleotide
gttttagaatgaaaaagattctgaattgatcctcgctaactttatttcagaaagtggtaaaatagctgtggagtacagacccagtgaagacatcgtaggt

SEQ ID NO: 833 - DNA, 50 bp, Artificial Sequence
  Description of Artificial Sequence: Synthetic oligonucleotide
cgctaactttatttcagaaagtggtaaaatagctgtggagtacagaccca

SEQ ID NO: 834 - DNA, 100 bp, Artificial Sequence
  Description of Artificial Sequence: Synthetic polynucleotide
tcaagcaattaatcccaagttgcttcagttggtcgaagacagaggttcagagtcagaatgagtatattgctaacctcaaggaccaactgcaagagatgaa

SEQ ID NO: 835 - DNA, 50 bp, Artificial Sequence
  Description of Artificial Sequence: Synthetic oligonucleotide
caagttgcttcagttggtcgaagacagaggttcagagtcagaatgagtat

SEQ ID NO: 836 - DNA, 50 bp, Artificial Sequence; identical to SEQ ID NO: 835
  Description of Artificial Sequence: Synthetic oligonucleotide

SEQ ID NO: 837 - DNA, 50 bp, Artificial Sequence
  Description of Artificial Sequence: Synthetic oligonucleotide
cagttggtcgaagacagaggttcagagtcagaatgagtatattgctaacc

SEQ ID NO: 838 - DNA, 50 bp, Artificial Sequence; identical to SEQ ID NO: 837
  Description of Artificial Sequence: Synthetic oligonucleotide

SEQ ID NO: 839 - DNA, 50 bp, Artificial Sequence; identical to SEQ ID NO: 837
  Description of Artificial Sequence: Synthetic oligonucleotide

SEQ ID NO: 840 - DNA, 50 bp, Artificial Sequence
  Description of Artificial Sequence: Synthetic oligonucleotide
cgaagacagaggttcagagtcagaacgagtatattgctaacctcaaggac

SEQ ID NO: 841 - DNA, 50 bp, Artificial Sequence
  Description of Artificial Sequence: Synthetic oligonucleotide
cgaagacagaggttcagagtcagaatgagtatattgctaacctcaaggac

SEQ ID NO: 842 - DNA, 50 bp, Artificial Sequence; identical to SEQ ID NO: 841
  Description of Artificial Sequence: Synthetic oligonucleotide

SEQ ID NO: 843 - DNA, 50 bp, Artificial Sequence; identical to SEQ ID NO: 841
  Description of Artificial Sequence: Synthetic oligonucleotide

SEQ ID NO: 844 - DNA, 48 bp, Artificial Sequence
  Description of Artificial Sequence: Synthetic oligonucleotide
cgaagacagaggttcagagtcagaatgagtatattgctaacctcaagg

SEQ ID NO: 845 - DNA, 50 bp, Artificial Sequence; identical to SEQ ID NO: 841
  Description of Artificial Sequence: Synthetic oligonucleotide

SEQ ID NO: 846 - DNA, 49 bp, Artificial Sequence
  Description of Artificial Sequence: Synthetic oligonucleotide
cagaggttcagagtcagaatgagtatattgctaacctcaaggaccaact

SEQ ID NO: 847 - DNA, 49 bp, Artificial Sequence; identical to SEQ ID NO: 846
  Description of Artificial Sequence: Synthetic oligonucleotide

SEQ ID NO: 848 - DNA, 50 bp, Artificial Sequence
  Description of Artificial Sequence: Synthetic oligonucleotide
agaggttcagagtcagaatgagtatattgctaacctcaaggaccaactgc

SEQ ID NO: 849 - DNA, 50 bp, Artificial Sequence; identical to SEQ ID NO: 848
  Description of Artificial Sequence: Synthetic oligonucleotide

SEQ ID NO: 850 - DNA, 100 bp, Artificial Sequence
  Description of Artificial Sequence: Synthetic polynucleotide
tcaagcaattaatcccaagttgcttcagttggtcgaagacagaggttcaggtcgttccaggggtagaggaggcatgaaggatgaccgtcgggacagatac

SEQ ID NO: 851 - DNA, 50 bp, Artificial Sequence
  Description of Artificial Sequence: Synthetic oligonucleotide
aagttgcttcagttggtcgaagacagaggttcaggtcgttccaggggtag

SEQ ID NO: 852 - DNA, 50 bp, Artificial Sequence; identical to SEQ ID NO: 851
  Description of Artificial Sequence: Synthetic oligonucleotide

SEQ ID NO: 853 - DNA, 50 bp, Artificial Sequence; identical to SEQ ID NO: 851
  Description of Artificial Sequence: Synthetic oligonucleotide

SEQ ID NO: 854 - DNA, 50 bp, Artificial Sequence
  Description of Artificial Sequence: Synthetic oligonucleotide
ttcagttggtcgaagacagaggttcaggtcgttccaggggtagaggaggc

SEQ ID NO: 855 - DNA, 50 bp, Artificial Sequence; identical to SEQ ID NO: 854
  Description of Artificial Sequence: Synthetic oligonucleotide

SEQ ID NO: 856 - DNA, 50 bp, Artificial Sequence
  Description of Artificial Sequence: Synthetic oligonucleotide
cagttggtcgaagacagaggttcaggtcgttccaggggtagaggaggcat

SEQ ID NO: 857 - DNA, 50 bp, Artificial Sequence; identical to SEQ ID NO: 856
  Description of Artificial Sequence: Synthetic oligonucleotide

SEQ ID NO: 858 - DNA, 50 bp, Artificial Sequence
  Description of Artificial Sequence: Synthetic oligonucleotide
cgaagacagaggttcaggtcgttccaggggtagaggaggcatgaaggatg

SEQ ID NO: 859 - DNA, 50 bp, Artificial Sequence
  Description of Artificial Sequence: Synthetic oligonucleotide
gacagaggttcaggtcgttccaggggtagaggaggtatgaaggatgaccg

SEQ ID NO: 860 - DNA, 49 bp, Artificial Sequence
  Description of Artificial Sequence: Synthetic oligonucleotide
cagaggttcaggtcgttccaggggtagaggaggcatgaaggatgaccgt

SEQ ID NO: 861 - DNA, 50 bp, Artificial Sequence
  Description of Artificial Sequence: Synthetic oligonucleotide
cagaggttcaggtcgttccaggggtagaggaggcatgaaggatgaccgtc

SEQ ID NO: 862 - DNA, 50 bp, Artificial Sequence; identical to SEQ ID NO: 861
  Description of Artificial Sequence: Synthetic oligonucleotide

SEQ ID NO: 863 - DNA, 50 bp, Artificial Sequence
  Description of Artificial Sequence: Synthetic oligonucleotide
aggttcaggtcgttccaggggtagaggaggcatgaaggatgaccgtcggg

SEQ ID NO: 864 - DNA, 50 bp, Artificial Sequence
  Description of Artificial Sequence: Synthetic oligonucleotide
gttcaggtcgttccaggggtagaggaggcatgaaggatgaccgtagggac

SEQ ID NO: 865 - DNA, 50 bp, Artificial Sequence
  Description of Artificial Sequence: Synthetic oligonucleotide
gttcaggtcgttccaggggtagaggaggcatgaaggatgaccgtcgggac

SEQ ID NO: 866 - DNA, 50 bp, Artificial Sequence; identical to SEQ ID NO: 865
  Description of Artificial Sequence: Synthetic oligonucleotide

SEQ ID NO: 867 - DNA, 50 bp, Artificial Sequence; identical to SEQ ID NO: 865
  Description of Artificial Sequence: Synthetic oligonucleotide

SEQ ID NO: 868 - DNA, 100 bp, Artificial Sequence
  Description of Artificial Sequence: Synthetic polynucleotide
ttcaaaaacagctaattaatgtcaaaaaggaatggcaatttgaagtccagagtcagaatgagtatattgctaacctcaaggaccaactgcaagagatgaa

SEQ ID NO: 869 - DNA, 100 bp, Artificial Sequence
  Description of Artificial Sequence: Synthetic polynucleotide
tcaagcaattaatcccaagttgcttcagttggtcgaagacagaggttcaggtaaggatgactgataggaaatgttggtagttacgagtcacatcgttgtc

SEQ ID NO: 870 - DNA, 50 bp, Artificial Sequence
  Description of Artificial Sequence: Synthetic oligonucleotide
caagttgcttcagttggtcgaagacagaggttcaggtaaggatgactgat

SEQ ID NO: 871 - DNA, 50 bp, Artificial Sequence
  Description of Artificial Sequence: Synthetic oligonucleotide
ttggtcgaagacagaggttcaggtaaggatgattgataggaaatgttggt

SEQ ID NO: 872 - DNA, 50 bp, Artificial Sequence; identical to SEQ ID NO: 871
  Description of Artificial Sequence: Synthetic oligonucleotide

SEQ ID NO: 873 - DNA, 50 bp, Artificial Sequence
  Description of Artificial Sequence: Synthetic oligonucleotide
ttggtcgaagacagaggttcaggtaaggatgactgataggaaatgttggt

SEQ ID NO: 874 - DNA, 50 bp, Artificial Sequence
  Description of Artificial Sequence: Synthetic oligonucleotide
aagacagaggttcaggtaaggatgactgataggaaatgttggtagttacg

SEQ ID NO: 875 - DNA, 50 bp, Artificial Sequence
  Description of Artificial Sequence: Synthetic oligonucleotide
gacagaggttcaggtaaggatgactgataggaaatgttggtagttacgag

SEQ ID NO: 876 - DNA, 50 bp, Artificial Sequence; identical to SEQ ID NO: 875
  Description of Artificial Sequence: Synthetic oligonucleotide

SEQ ID NO: 877 - DNA, 50 bp, Artificial Sequence
  Description of Artificial Sequence: Synthetic oligonucleotide
acagaggttcaggtaaggatgactgataggaaatgttggtagttacgagt

SEQ ID NO: 878 - DNA, 50 bp, Artificial Sequence; identical to SEQ ID NO: 877
  Description of Artificial Sequence: Synthetic oligonucleotide

SEQ ID NO: 879 - DNA, 50 bp, Artificial Sequence; identical to SEQ ID NO: 877
  Description of Artificial Sequence: Synthetic oligonucleotide

SEQ ID NO: 880 - DNA, 50 bp, Artificial Sequence; identical to SEQ ID NO: 877
  Description of Artificial Sequence: Synthetic oligonucleotide

SEQ ID NO: 881 - DNA, 50 bp, Artificial Sequence; identical to SEQ ID NO: 877
  Description of Artificial Sequence: Synthetic oligonucleotide

SEQ ID NO: 882 - DNA, 50 bp, Artificial Sequence
  Description of Artificial Sequence: Synthetic oligonucleotide
aggttcaggtaaggatgactgataggaaatgttggtagttacgagtcaca

SEQ ID NO: 883 - DNA, 50 bp, Artificial Sequence; identical to SEQ ID NO: 882
  Description of Artificial Sequence: Synthetic oligonucleotide

SEQ ID NO: 884 - DNA, 50 bp, Artificial Sequence; identical to SEQ ID NO: 882
  Description of Artificial Sequence: Synthetic oligonucleotide

SEQ ID NO: 885 - DNA, 50 bp, Artificial Sequence
  Description of Artificial Sequence: Synthetic oligonucleotide
ggttcaggtaaggatgactgataggaaatgttggtagttacgagtcacat

SEQ ID NO: 886 - DNA, 50 bp, Artificial Sequence; identical to SEQ ID NO: 885
  Description of Artificial Sequence: Synthetic oligonucleotide

SEQ ID NO: 887 - DNA, 100 bp, Artificial Sequence
  Description of Artificial Sequence: Synthetic polynucleotide
atggaggtagaatgtattttcaatttagaaacctggtctttccactacagagtcagaatgagtatattgctaacctcaaggaccaactgcaagagatgaa

SEQ ID NO: 888 - DNA, 100 bp, Artificial Sequence
  Description of Artificial Sequence: Synthetic polynucleotide
cgacaccatgggcctgcgggaggacctgctgcggggcatctacgcttacgaggaacgagtacctgctgacggtggtggcagaggagagcgacctgctgct

SEQ ID NO: 889 - DNA, 49 bp, Artificial Sequence
  Description of Artificial Sequence: Synthetic oligonucleotide
cggggcatctacgcttacgaggaacgagtacctgctgacggtggtggca

SEQ ID NO: 890 - DNA, 100 bp, Artificial Sequence
  Description of Artificial Sequence: Synthetic polynucleotide
cgacaccatgggcctgcgggaggacctgctgcggggcatctacgcttacggttttgaaaaaccatcagcaatccagcaacgagcaatcaagcagatcatc

SEQ ID NO: 891 - DNA, 50 bp, Artificial Sequence
  Description of Artificial Sequence: Synthetic oligonucleotide
gctgcggggcatctacgcttacggttttgaaaaaccatcagcaatccagc

SEQ ID NO: 892 - DNA, 50 bp, Artificial Sequence
  Description of Artificial Sequence: Synthetic oligonucleotide
ggggcatctacgcttacggttttgaaaaaccatcagcaatccagcaacga

SEQ ID NO: 893 - DNA, 50 bp, Artificial Sequence; identical to SEQ ID NO: 892
  Description of Artificial Sequence: Synthetic oligonucleotide

SEQ ID NO: 894 - DNA, 49 bp, Artificial Sequence
  Description of Artificial Sequence: Synthetic oligonucleotide
ggggcatctacgcttacggttttgaaaaaccatcagcaatccagcaacg

SEQ ID NO: 895 - DNA, 100 bp, Artificial Sequence
  Description of Artificial Sequence: Synthetic polynucleotide
aagaattttccatcgtcgtaactttgagagttcccaatcttccacccaagaggaacgagtacctgctgacggtggtggcagaggagagcgacctgctgct

SEQ ID NO: 896 - DNA, 100 bp, Artificial Sequence
  Description of Artificial Sequence: Synthetic polynucleotide
cgacaccatgggcctgcgggaggacctgctgcggggcatctacgcttacggtgagcgggcgcgggccgcgggggccagccgggggcgagtcgggggcgag

SEQ ID NO: 897 - DNA, 100 bp, Artificial Sequence
  Description of Artificial Sequence: Synthetic polynucleotide
acccgacccctacccccagccccgtcctgagcctggcccgctctccacagaggaacgagtacctgctgacggtggtggcagaggagagcgacctgctgct

SEQ ID NO: 898 - DNA, 100 bp, Artificial Sequence
  Description of Artificial Sequence: Synthetic polynucleotide
aatggaacacagacaatactctagggacagaaatctcttgggagaataagccgatggatgcactgactggtctatcgatatcaagaaatatcaagttttg

SEQ ID NO: 899 - DNA, 50 bp, Artificial Sequence
  Description of Artificial Sequence: Synthetic oligonucleotide
agggacagaaatctcttgggagaataagccgatggatgcactgactggtc

SEQ ID NO: 900 - DNA, 50 bp, Artificial Sequence; identical to SEQ ID NO: 899
  Description of Artificial Sequence: Synthetic oligonucleotide

SEQ ID NO: 901 - DNA, 50 bp, Artificial Sequence; identical to SEQ ID NO: 899
  Description of Artificial Sequence: Synthetic oligonucleotide

SEQ ID NO: 902 - DNA, 50 bp, Artificial Sequence; identical to SEQ ID NO: 899
  Description of Artificial Sequence: Synthetic oligonucleotide

SEQ ID NO: 903 - DNA, 50 bp, Artificial Sequence; identical to SEQ ID NO: 899
  Description of Artificial Sequence: Synthetic oligonucleotide

SEQ ID NO: 904 - DNA, 49 bp, Artificial Sequence
  Description of Artificial Sequence: Synthetic oligonucleotide
gggagaataagccgatggatgcactgactggtctatcgatatcaagaaa

SEQ ID NO: 905 - DNA, 49 bp, Artificial Sequence; identical to SEQ ID NO: 904
  Description of Artificial Sequence: Synthetic oligonucleotide

SEQ ID NO: 906 - DNA, 100 bp, Artificial Sequence
  Description of Artificial Sequence: Synthetic polynucleotide
aatggaacacagacaatactctagggacagaaatctcttgggagaataagttggctgaagggttgaaactgactcttgataccatatttgtaccgaacac

SEQ ID NO: 907 - DNA, 50 bp, Artificial Sequence
  Description of Artificial Sequence: Synthetic oligonucleotide
ctagggacagaaatctcttgggagaataagttggctgaagggttgaaact

SEQ ID NO: 908 - DNA, 50 bp, Artificial Sequence; identical to SEQ ID NO: 907
  Description of Artificial Sequence: Synthetic oligonucleotide

SEQ ID NO: 909 - DNA, 50 bp, Artificial Sequence; identical to SEQ ID NO: 907
  Description of Artificial Sequence: Synthetic oligonucleotide

SEQ ID NO: 910 - DNA, 50 bp, Artificial Sequence; identical to SEQ ID NO: 907
  Description of Artificial Sequence: Synthetic oligonucleotide

SEQ ID NO: 911 - DNA, 50 bp, Artificial Sequence; identical to SEQ ID NO: 907
  Description of Artificial Sequence: Synthetic oligonucleotide

SEQ ID NO: 912 - DNA, 50 bp, Artificial Sequence; identical to SEQ ID NO: 907
  Description of Artificial Sequence: Synthetic oligonucleotide

SEQ ID NO: 913 - DNA, 50 bp, Artificial Sequence
  Description of Artificial Sequence: Synthetic oligonucleotide
agggacagaaatctcttgggagaataagttggctgaagggttgaaactga

SEQ ID NO: 914 - DNA, 50 bp, Artificial Sequence; identical to SEQ ID NO: 913
  Description of Artificial Sequence: Synthetic oligonucleotide

SEQ ID NO: 915 - DNA, 50 bp, Artificial Sequence
  Description of Artificial Sequence: Synthetic oligonucleotide
cttgggagaataagttggctgaagggttgaaactgaatcttgataccata

SEQ ID NO: 916 - DNA, 50 bp, Artificial Sequence; identical to SEQ ID NO: 915
  Description of Artificial Sequence: Synthetic oligonucleotide

SEQ ID NO: 917 - DNA, 100 bp, Artificial Sequence
  Description of Artificial Sequence: Synthetic polynucleotide
atacgctacttttactcagagtttgaaggttgtgaccaaaagaggctccgccgatggatgcactgactggtctatcgatatcaagaaatatcaagttttg

SEQ ID NO: 918 - DNA, 100 bp, Artificial Sequence
  Description of Artificial Sequence: Synthetic polynucleotide
aatggaacacagacaatactctagggacagaaatctcttgggagaataaggtaagagaacgcattagaagttattcataggttcaatttatcttgtagat

SEQ ID NO: 919 - DNA, 50 bp, Artificial Sequence
  Description of Artificial Sequence: Synthetic oligonucleotide
gggagaataaggtaagagaacgcattagaagttattcataggttcaattt

SEQ ID NO: 920 - DNA, 100 bp, Artificial Sequence
  Description of Artificial Sequence: Synthetic polynucleotide
tttgcctctaatgtttttcctctctttctctgtctctttttttacgatagccgatggatgcactgactggtctatcgatatcaagaaatatcaagttttg

SEQ ID NO: 921 - DNA, 100 bp, Artificial Sequence
  Description of Artificial Sequence: Synthetic polynucleotide
acttgggattttgtggatccaacccaaagagtcagctgttcttgttccagaataagaccacagcttgccaaagagaagattgaaggatgccatatttgta

SEQ ID NO: 922 - DNA, 50 bp, Artificial Sequence
  Description of Artificial Sequence: Synthetic oligonucleotide
aacccaaagagtcagctgttcttgttccagaataagaccacagcttgcca

SEQ ID NO: 923 - DNA, 50 bp, Artificial Sequence; identical to SEQ ID NO: 922
  Description of Artificial Sequence: Synthetic oligonucleotide

SEQ ID NO: 924 - DNA, 50 bp, Artificial Sequence; identical to SEQ ID NO: 922
  Description of Artificial Sequence: Synthetic oligonucleotide

SEQ ID NO: 925 - DNA, 100 bp, Artificial Sequence
  Description of Artificial Sequence: Synthetic polynucleotide
acttgggattttgtggatccaacccaaagagtcagctgttcttgttccaggcataagcttttaaaacgttgtgcagtcgggcccaatcgacctcccacag

SEQ ID NO: 926 - DNA, 100 bp, Artificial Sequence
  Description of Artificial Sequence: Synthetic polynucleotide
gccagcatgttgggcgccccggacgagagctccgtgcgggtggctgtcagaataagaccacagcttgccaaagagaagattgaaggatgccatatttgta

SEQ ID NO: 927 - DNA, 100 bp, Artificial Sequence
  Description of Artificial Sequence: Synthetic polynucleotide
acttgggattttgtggatccaacccaaagagtcagctgttcttgttccaggtaggtaataaaaaaggcaaaatagtaatggatcgaatgatggcgcatct

SEQ ID NO: 928 - DNA, 100 bp, Artificial Sequence
  Description of Artificial Sequence: Synthetic polynucleotide
ttttttttgccatttattttatttttttcttttctgattatttctcacagaataagaccacagcttgccaaagagaagattgaaggatgccatatttgta

SEQ ID NO: 929 - DNA, 100 bp, Artificial Sequence
  Description of Artificial Sequence: Synthetic polynucleotide
tgtctatgacatgctggctggaaagttaattcctgtgcatcaagtgagaggtcctcgggcgggaagtgtacacctccaataaccagctggggggcatcca

SEQ ID NO: 930 - DNA, 50 bp, Artificial Sequence
  Description of Artificial Sequence: Synthetic oligonucleotide
ggctggaaagttaattcctgtgcatcaagtgagaggtcctcgggcgggaa

SEQ ID NO: 931 - DNA, 50 bp, Artificial Sequence
  Description of Artificial Sequence: Synthetic oligonucleotide
gagaggtcctcgggcgggaagtgtacacctccaataaccagctggggggc

SEQ ID NO: 932 - DNA, 50 bp, Artificial Sequence; identical to SEQ ID NO: 931
  Description of Artificial Sequence: Synthetic oligonucleotide

SEQ ID NO: 933 - DNA, 50 bp, Artificial Sequence; identical to SEQ ID NO: 931
  Description of Artificial Sequence: Synthetic oligonucleotide

SEQ ID NO: 934 - DNA, 50 bp, Artificial Sequence; identical to SEQ ID NO: 931
  Description of Artificial Sequence: Synthetic oligonucleotide

SEQ ID NO: 935 - DNA, 100 bp, Artificial Sequence
  Description of Artificial Sequence: Synthetic polynucleotide
tgtctatgacatgctggctggaaagttaattcctgtgcatcaagtgagaggtttgaaagagaagatagtgaggagctttgaagtctccccagatgggtcc

SEQ ID NO: 936 - DNA, 50 bp, Artificial Sequence
  Description of Artificial Sequence: Synthetic oligonucleotide
gagaggtttgaaagagaagatagtgaggagctttgaagtctccccagatg

SEQ ID NO: 937 - DNA, 50 bp, Artificial Sequence; identical to SEQ ID NO: 936
  Description of Artificial Sequence: Synthetic oligonucleotide

SEQ ID NO: 938 - DNA, 100 bp, Artificial Sequence
  Description of Artificial Sequence: Synthetic polynucleotide
aggttgagaattctcacttaattctaacaggagctggagccctcaacaaagtcctcgggcgggaagtgtacacctccaataaccagctggggggcatcca

SEQ ID NO: 939 - DNA, 50 bp, Artificial Sequence
  Description of Artificial Sequence: Synthetic oligonucleotide
gagaattctcacttaattctaacaggagctggagccctcaacaaagtcct

SEQ ID NO: 940 - DNA, 100 bp, Artificial Sequence
  Description of Artificial Sequence: Synthetic polynucleotide
tgtctatgacatgctggctggaaagttaattcctgtgcatcaagtgagaggtaagatttctgttgaatgcacacaaccagtcattccccccaaggtgagt

SEQ ID NO: 941 - DNA, 100 bp, Artificial Sequence
  Description of Artificial Sequence: Synthetic polynucleotide
gcctttatttctatagagacaaatgtcttttctcttgctcttttctctaggtcctcgggcgggaagtgtacacctccaataaccagctggggggcatcca

SEQ ID NO: 942 - DNA, 100 bp, Artificial Sequence
  Description of Artificial Sequence: Synthetic polynucleotide
gacgaaaacgtattgctgagagggagcgtgagcgagaaaaattgagagaggtaaatggtcttaaaatggttgatgagccaatggaagagggagaagcaga

SEQ ID NO: 943 - DNA, 50 bp, Artificial Sequence
  Description of Artificial Sequence: Synthetic oligonucleotide
gagggagcgtgagcgagaaaaattgagagaggtaaatggtcttaaaatgg

SEQ ID NO: 944 - DNA, 100 bp, Artificial Sequence
  Description of Artificial Sequence: Synthetic polynucleotide
gacgaaaacgtattgctgagagggagcgtgagcgagaaaaattgagagaggtgatagaaattgaagatgcttcacccaccaagtgtccaataacaaccaa

SEQ ID NO: 945 - DNA, 50 bp, Artificial Sequence
  Description of Artificial Sequence: Synthetic oligonucleotide
agcgtgagcgagaaaaattgagagaggtgatagaaattgaagatgcttca

SEQ ID NO: 946 - DNA, 50 bp, Artificial Sequence; identical to SEQ ID NO: 945
  Description of Artificial Sequence: Synthetic oligonucleotide

SEQ ID NO: 947 - DNA, 50 bp, Artificial Sequence
  Description of Artificial Sequence: Synthetic oligonucleotide
gcgagaaaaattgagagaggtgatagaaattgaagatgcttcacccacca

SEQ ID NO: 948 - DNA, 100 bp, Artificial Sequence
  Description of Artificial Sequence: Synthetic polynucleotide
gggaccgagaaatggaagtgttcagcggcggcggcgcgagcagcggcgaggtaaatggtcttaaaatggttgatgagccaatggaagagggagaagcaga

SEQ ID NO: 949 - DNA, 50 bp, Artificial Sequence
  Description of Artificial Sequence: Synthetic oligonucleotide
gcggcgaggtaaatggtcttaaaatggttgatgagccaatggaagaggga

SEQ ID NO: 950 - DNA, 49 bp, Artificial Sequence
  Description of Artificial Sequence: Synthetic oligonucleotide
gcggcgaggtaaatggtcttaaaatggttgatgagccaatggaagaggg

SEQ ID NO: 951 - DNA, 100 bp, Artificial Sequence
  Description of Artificial Sequence: Synthetic polynucleotide
gacgaaaacgtattgctgagagggagcgtgagcgagaaaaattgagagaggtaactaatttctttcttcttctttttcttttgtagctacagggtcttgc

SEQ ID NO: 952 - DNA, 50 bp, Artificial Sequence
  Description of Artificial Sequence: Synthetic oligonucleotide
cgtgagcgagaaaaattgagagaggtaactaatttctttcttcttttttt

SEQ ID NO: 953 - DNA, 100 bp, Artificial Sequence
  Description of Artificial Sequence: Synthetic polynucleotide
actcttgttttaatacttttgaacctcaatttttgaacaatgtttttcaggtaaatggtcttaaaatggttgatgagccaatggaagagggagaagcaga

SEQ ID NO: 954 - DNA, 100 bp, Artificial Sequence
  Description of Artificial Sequence: Synthetic polynucleotide
agctttgccacaaagcccagtctgtgtctcaaatcaaccacaagctggagaatcgggaccagtattcacatctgctaagtgatcattttctgccatacca

SEQ ID NO: 955 - DNA, 49 bp, Artificial Sequence
  Description of Artificial Sequence: Synthetic oligonucleotide
tgtgtctcaaatcaaccacaagctggagaatcgggaccagtattcacat

SEQ ID NO: 956 - DNA, 100 bp, Artificial Sequence
  Description of Artificial Sequence: Synthetic polynucleotide
agctttgccacaaagcccagtctgtgtctcaaatcaaccacaagctggaggcacagttggtggatctgaaatctgaactgacagaaacccaagcagagaa

SEQ ID NO: 957 - DNA, 100 bp, Artificial Sequence
  Description of Artificial Sequence: Synthetic polynucleotide
gtcacacatcaaggcgcttgatcacaatggaaaaggtgaagaaatttgagaatcgggaccagtattcacatctgctaagtgatcattttctgccatacca

SEQ ID NO: 958 - DNA, 100 bp, Artificial Sequence
  Description of Artificial Sequence: Synthetic polynucleotide
agctttgccacaaagcccagtctgtgtctcaaatcaaccacaagctggaggtgagccgtgggtgctggcggctatggcatccaaccccaggctgcccggt

SEQ ID NO: 959 - DNA, 100 bp, Artificial Sequence
  Description of Artificial Sequence: Synthetic polynucleotide
aagctaactaaagaaataatttttacattttgtattttccaaccaaacagaatcgggaccagtattcacatctgctaagtgatcattttctgccatacca

SEQ ID NO: 960 - DNA, 100 bp, Artificial Sequence
  Description of Artificial Sequence: Synthetic polynucleotide
agaagctggaagccctggagcagctgcagtcccacatcgaaggctgggaggaggttccccaatacaactcatgagggtttcaatgtcaccctccacacca

SEQ ID NO: 961 - DNA, 50 bp, Artificial Sequence
  Description of Artificial Sequence: Synthetic oligonucleotide
ggaagccctggagcagctgcagtcccacatcgaaggctgggaggaggttc

SEQ ID NO: 962 - DNA, 50 bp, Artificial Sequence; identical to SEQ ID NO: 961
  Description of Artificial Sequence: Synthetic oligonucleotide

SEQ ID NO: 963 - DNA, 50 bp, Artificial Sequence; identical to SEQ ID NO: 961
  Description of Artificial Sequence: Synthetic oligonucleotide

SEQ ID NO: 964 - DNA, 50 bp, Artificial Sequence; identical to SEQ ID NO: 961
  Description of Artificial Sequence: Synthetic oligonucleotide

SEQ ID NO: 965 - DNA, 50 bp, Artificial Sequence
  Description of Artificial Sequence: Synthetic oligonucleotide
ccctggagcagctgcagtcccacatcgaaggctgggaggaggttccccaa

SEQ ID NO: 966 - DNA, 50 bp, Artificial Sequence
  Description of Artificial Sequence: Synthetic oligonucleotide
ggagcagctgcagtcccacatcgaaggctgggaggaggttccccaataca

SEQ ID NO: 967 - DNA, 50 bp, Artificial Sequence
  Description of Artificial Sequence: Synthetic oligonucleotide
gcagctgcagtcccacatcgaaggctgggaggaggttccccaatacaact

SEQ ID NO: 968 - DNA, 50 bp, Artificial Sequence; identical to SEQ ID NO: 967
  Description of Artificial Sequence: Synthetic oligonucleotide

SEQ ID NO: 969 - DNA, 50 bp, Artificial Sequence
  Description of Artificial Sequence: Synthetic oligonucleotide
gcagtcccacatcgaagcctgggaggaggttccccaatacaactcatgag

SEQ ID NO: 970 - DNA, 50 bp, Artificial Sequence
  Description of Artificial Sequence: Synthetic oligonucleotide
gcagtcccacatcgaaggctgggaggaggttccccaatacaactcatgag

SEQ ID NO: 971 - DNA, 50 bp, Artificial Sequence; identical to SEQ ID NO: 970
  Description of Artificial Sequence: Synthetic oligonucleotide

SEQ ID NO: 972 - DNA, 50 bp, Artificial Sequence; identical to SEQ ID NO: 970
  Description of Artificial Sequence: Synthetic oligonucleotide

SEQ ID NO: 973 - DNA, 50 bp, Artificial Sequence
  Description of Artificial Sequence: Synthetic oligonucleotide
cgaaggctgggaggaggttccccaatacaactcatgagggtttcaatgtc

SEQ ID NO: 974 - DNA, 50 bp, Artificial Sequence
  Description of Artificial Sequence: Synthetic oligonucleotide
aaggctgggaggaggttccccaatacaactcatgagggtttcaatgtcac

SEQ ID NO: 975 - DNA, 50 bp, Artificial Sequence; identical to SEQ ID NO: 974
  Description of Artificial Sequence: Synthetic oligonucleotide

SEQ ID NO: 976 - DNA, 50 bp, Artificial Sequence
  Description of Artificial Sequence: Synthetic oligonucleotide
ctgggaggaggttccccaatacaactcatgagggtttcaatgtcaccctc

SEQ ID NO: 977 - DNA, 50 bp, Artificial Sequence
  Description of Artificial Sequence: Synthetic oligonucleotide
gggaggaggttccccaatacaactcatgagggtttcaatgtcaccctcca

SEQ ID NO: 978 - DNA, 50 bp, Artificial Sequence; identical to SEQ ID NO: 977
  Description of Artificial Sequence: Synthetic oligonucleotide

SEQ ID NO: 979 - DNA, 50 bp, Artificial Sequence; identical to SEQ ID NO: 977
  Description of Artificial Sequence: Synthetic oligonucleotide

SEQ ID NO: 980 - DNA, 50 bp, Artificial Sequence; identical to SEQ ID NO: 977
  Description of Artificial Sequence: Synthetic oligonucleotide

SEQ ID NO: 981 - DNA, 47 bp, Artificial Sequence
  Description of Artificial Sequence: Synthetic oligonucleotide
gggaggaggttccccaatacaactcatgagggtttcaatgtcaccct

SEQ ID NO: 982 - DNA, 50 bp, Artificial Sequence; identical to SEQ ID NO: 977
  Description of Artificial Sequence: Synthetic oligonucleotide

SEQ ID NO: 983 - DNA, 100 bp, Artificial Sequence
  Description of Artificial Sequence: Synthetic polynucleotide
agaagctggaagccctggagcagctgcagtcccacatcgaaggctgggagggttccaacctcacagacatctgcactcagctcctcctgcaagggacttt

SEQ ID NO: 984 - DNA, 50 bp, Artificial Sequence
  Description of Artificial Sequence: Synthetic oligonucleotide
gctgcagtcccacatcgaaggctgggagggttccaacctcacagacatct

SEQ ID NO: 985 - DNA, 50 bp, Artificial Sequence
  Description of Artificial Sequence: Synthetic oligonucleotide
gcagtcccacatcgaaggctgggagggttccaacctcacagacatctgca

SEQ ID NO: 986 - DNA, 50 bp, Artificial Sequence; identical to SEQ ID NO: 985
  Description of Artificial Sequence: Synthetic oligonucleotide

SEQ ID NO: 987 - DNA, 50 bp, Artificial Sequence; identical to SEQ ID NO: 985
  Description of Artificial Sequence: Synthetic oligonucleotide

SEQ ID NO: 988 - DNA, 50 bp, Artificial Sequence
  Description of Artificial Sequence: Synthetic oligonucleotide
aaggctgggagggttccaacgtcacagacatctgcactcagctcctcctg

SEQ ID NO: 989 - DNA, 50 bp, Artificial Sequence
  Description of Artificial Sequence: Synthetic oligonucleotide
aaggctgggagggttccaacctcacagacatctgcactcagctcctcctg

SEQ ID NO: 990 - DNA, 50 bp, Artificial Sequence; identical to SEQ ID NO: 989
  Description of Artificial Sequence: Synthetic oligonucleotide

SEQ ID NO: 991 - DNA, 50 bp, Artificial Sequence; identical to SEQ ID NO: 989
  Description of Artificial Sequence: Synthetic oligonucleotide

SEQ ID NO: 992 - DNA, 50 bp, Artificial Sequence; identical to SEQ ID NO: 989
  Description of Artificial Sequence: Synthetic oligonucleotide

SEQ ID NO: 993 - DNA, 50 bp, Artificial Sequence; identical to SEQ ID NO: 989
  Description of Artificial Sequence: Synthetic oligonucleotide

SEQ ID NO: 994 - DNA, 50 bp, Artificial Sequence
  Description of Artificial Sequence: Synthetic oligonucleotide
aggctgggagggttccaacctcacagacatctgcactcagctcctcctgc

SEQ ID NO: 995 - DNA, 50 bp, Artificial Sequence; identical to SEQ ID NO: 994
  Description of Artificial Sequence: Synthetic oligonucleotide

SEQ ID NO: 996 - DNA, 50 bp, Artificial Sequence
  Description of Artificial Sequence: Synthetic oligonucleotide
aggctgggagggttccaacttcacagacatctgcactcagctcctcctgc

SEQ ID NO: 997 - DNA, 50 bp, Artificial Sequence; identical to SEQ ID NO: 996
  Description of Artificial Sequence: Synthetic oligonucleotide

SEQ ID NO: 998 - DNA, 50 bp, Artificial Sequence; identical to SEQ ID NO: 994
  Description of Artificial Sequence: Synthetic oligonucleotide

SEQ ID NO: 999 - DNA, 50 bp, Artificial Sequence; identical to SEQ ID NO: 994
  Description of Artificial Sequence: Synthetic oligonucleotide

SEQ ID NO: 1000 - DNA, 50 bp, Artificial Sequence; identical to SEQ ID NO: 994
  Description of Artificial Sequence: Synthetic oligonucleotide

SEQ ID NO: 1001 - DNA, 50 bp, Artificial Sequence; identical to SEQ ID NO: 994
  Description of Artificial Sequence: Synthetic oligonucleotide

SEQ ID NO: 1002 - DNA, 50 bp, Artificial Sequence
  Description of Artificial Sequence: Synthetic oligonucleotide
ggctgggagggttccaacctcacagacatctgcactcagctcctcctgca

SEQ ID NO: 1003 - DNA, 50 bp, Artificial Sequence
  Description of Artificial Sequence: Synthetic oligonucleotide
gctgggagggttccaacctcacagacatctgcactcagctcctcctgcaa

SEQ ID NO: 1004 - DNA, 50 bp, Artificial Sequence; identical to SEQ ID NO: 1003
  Description of Artificial Sequence: Synthetic oligonucleotide

SEQ ID NO: 1005 - DNA, 50 bp, Artificial Sequence
  Description of Artificial Sequence: Synthetic oligonucleotide
gctgggagggttccaacctcacagacagctgcactcagctcctcctgcaa

SEQ ID NO: 1006 - DNA, 50 bp, Artificial Sequence; identical to SEQ ID NO: 1003
  Description of Artificial Sequence: Synthetic oligonucleotide

SEQ ID NO: 1007 - DNA, 50 bp, Artificial Sequence; identical to SEQ ID NO: 1003
  Description of Artificial Sequence: Synthetic oligonucleotide

SEQ ID NO: 1008 - DNA, 50 bp, Artificial Sequence; identical to SEQ ID NO: 1003
  Description of Artificial Sequence: Synthetic oligonucleotide

SEQ ID NO: 1009 - DNA, 50 bp, Artificial Sequence
  Description of Artificial Sequence: Synthetic oligonucleotide
gctgggagggttccaacctcacagacatctgcactcagcttctcctgcaa

SEQ ID NO: 1010 - DNA, 50 bp, Artificial Sequence; identical to SEQ ID NO: 1009
  Description of Artificial Sequence: Synthetic oligonucleotide

SEQ ID NO: 1011 - DNA, 50 bp, Artificial Sequence; identical to SEQ ID NO: 1003
  Description of Artificial Sequence: Synthetic oligonucleotide

SEQ ID NO: 1012 - DNA, 50 bp, Artificial Sequence
  Description of Artificial Sequence: Synthetic oligonucleotide
tgggagggttccaacctcacagacatctgcactcagctcctcctgcaagg

SEQ ID NO: 1013 - DNA, 50 bp, Artificial Sequence; identical to SEQ ID NO: 1012
  Description of Artificial Sequence: Synthetic oligonucleotide

SEQ ID NO: 1014 - DNA, 49 bp, Artificial Sequence
  Description of Artificial Sequence: Synthetic oligonucleotide
gggagggttccaacctcacagacatctgcactcagctcctcctgcaagg

SEQ ID NO: 1015 - DNA, 50 bp, Artificial Sequence
  Description of Artificial Sequence: Synthetic oligonucleotide
gggagggttccaacctcacagacatctgtactcagctcctcctgcaaggg

SEQ ID NO: 1016 - DNA, 50 bp, Artificial Sequence
  Description of Artificial Sequence: Synthetic oligonucleotide
gggagggttccaacctcacagacatctgcactcagctcctcctgcaaggg

SEQ ID NO: 1017 - DNA, 50 bp, Artificial Sequence; identical to SEQ ID NO: 1016
  Description of Artificial Sequence: Synthetic oligonucleotide

SEQ ID NO: 1018 - DNA, 50 bp, Artificial Sequence; identical to SEQ ID NO: 1016
  Description of Artificial Sequence: Synthetic oligonucleotide

SEQ ID NO: 1019 - DNA, 50 bp, Artificial Sequence; identical to SEQ ID NO: 1016
  Description of Artificial Sequence: Synthetic oligonucleotide

SEQ ID NO: 1020 - DNA, 50 bp, Artificial Sequence; identical to SEQ ID NO: 1016
  Description of Artificial Sequence: Synthetic oligonucleotide

SEQ ID NO: 1021 - DNA, 100 bp, Artificial Sequence
  Description of Artificial Sequence: Synthetic polynucleotide
cggtggtcctggaagctccgcaggatgggggagaagatggcggaagaggagaggttccccaatacaactcatgagggtttcaatgtcaccctccacacca

SEQ ID NO: 1022 - DNA, 100 bp, Artificial Sequence
  Description of Artificial Sequence: Synthetic polynucleotide
agaagctggaagccctggagcagctgcagtcccacatcgaaggctgggaggtgtgtacaggacaggagggggcttcctgggccgcagggggccaggaggt

SEQ ID NO: 1023 - DNA, 50 bp, Artificial Sequence
  Description of Artificial Sequence: Synthetic oligonucleotide
gggaggtgtgtacaggacaggagggggctttctgggccgcagggggccag

SEQ ID NO: 1024 - DNA, 100 bp, Artificial Sequence
  Description of Artificial Sequence: Synthetic polynucleotide
tgttttgggacccttttccattatctaattatgctttctatgtcctccaggaggttccccaatacaactcatgagggtttcaatgtcaccctccacacca

SEQ ID NO: 1025 - DNA, 100 bp, Artificial Sequence
  Description of Artificial Sequence: Synthetic polynucleotide
caaagttctgtgctcgttgtggaggtcgagtgtcattacgctcaaacaagcatagtggtaaaatggatgaaaacagatttgtggcagttaccagcacaaa

SEQ ID NO: 1026 - DNA, 50 bp, Artificial Sequence
  Description of Artificial Sequence: Synthetic oligonucleotide
gtggaggtcgagtgtcattacgctcaaacaagcatagtggtaaaatggat

SEQ ID NO: 1027 - DNA, 50 bp, Artificial Sequence; identical to SEQ ID NO: 1026
  Description of Artificial Sequence: Synthetic oligonucleotide

SEQ ID NO: 1028 - DNA, 50 bp, Artificial Sequence
  Description of Artificial Sequence: Synthetic oligonucleotide
ggaggtcgagtgtcattacgctcaaacaagcatagtggtaaaatggatga

SEQ ID NO: 1029 - DNA, 100 bp, Artificial Sequence
  Description of Artificial Sequence: Synthetic polynucleotide
caaagttctgtgctcgttgtggaggtcgagtgtcattacgctcaaacaaggttatgtgggtatgtaatttgtgccgaaaacaacaagaaatcctcactaa

SEQ ID NO: 1030 - DNA, 50 bp, Artificial Sequence
  Description of Artificial Sequence: Synthetic oligonucleotide
tgtggaggtcgagtgtcattacgctcaaacaaggttatgtgggtatgtaa

SEQ ID NO: 1031 - DNA, 50 bp, Artificial Sequence; identical to SEQ ID NO: 1030
  Description of Artificial Sequence: Synthetic oligonucleotide

SEQ ID NO: 1032 - DNA, 50 bp, Artificial Sequence
  Description of Artificial Sequence: Synthetic oligonucleotide
gtggaggtcgagtgtcattacgctcaaacaaggttatgtgggtatgtaat

SEQ ID NO: 1033 - DNA, 50 bp, Artificial Sequence; identical to SEQ ID NO: 1032
  Description of Artificial Sequence: Synthetic oligonucleotide

SEQ ID NO: 1034 - DNA, 50 bp, Artificial Sequence
  Description of Artificial Sequence: Synthetic oligonucleotide
tggaggtcgagtgtcattacgctcaaacaaggttatgtgggtatgtaatt

SEQ ID NO: 1035 - DNA, 100 bp, Artificial Sequence
  Description of Artificial Sequence: Synthetic polynucleotide
gggtgaatggtgttgaagatcggatgtccgtaatatgggaaaaaggcgtgcatagtggtaaaatggatgaaaacagatttgtggcagttaccagcacaaa

SEQ ID NO: 1036 - DNA, 100 bp, Artificial Sequence
  Description of Artificial Sequence: Synthetic polynucleotide
caaagttctgtgctcgttgtggaggtcgagtgtcattacgctcaaacaaggtacagaaatgaaaattacagttctcttctagttaagcttattgtgttta

SEQ ID NO: 1037 - DNA, 100 bp, Artificial Sequence
  Description of Artificial Sequence: Synthetic polynucleotide
atactttttagtatttgatcattagaatgattctttgaattgctttacagcatagtggtaaaatggatgaaaacagatttgtggcagttaccagcacaaa

SEQ ID NO: 1038 - DNA, 100 bp, Artificial Sequence
  Description of Artificial Sequence: Synthetic polynucleotide
tacgtgtgcctggtgctgctggtggccaacattttgcggatactcttctgagtcttgctctgtcgcccaggctggagtgcagtggtgcgaccttggctca

SEQ ID NO: 1039 - DNA, 50 bp, Artificial Sequence
  Description of Artificial Sequence: Synthetic oligonucleotide
gctggtggccaacattttgcggatactcttctgagtcttgctctgtcgcc

SEQ ID NO: 1040 - DNA, 100 bp, Artificial Sequence
  Description of Artificial Sequence: Synthetic polynucleotide
tacgtgtgcctggtgctgctggtggccaacattttgcggatactcttctggtttggaaggcgctttgagtccccgctgctgtggcagagcgccatcatga

SEQ ID NO: 1041 - DNA, 100 bp, Artificial Sequence
  Description of Artificial Sequence: Synthetic polynucleotide
catgaaggtccaccggcagtcgaatcagccaaagcacaagacaaacacaaagtcttgctctgtcgcccaggctggagtgcagtggtgcgaccttggctca

SEQ ID NO: 1042 - DNA, 100 bp, Artificial Sequence
  Description of Artificial Sequence: Synthetic polynucleotide
tacgtgtgcctggtgctgctggtggccaacattttgcggatactcttctggtaagttgggggcttgctttcctgggctgcacccggagaagagggtttct

SEQ ID NO: 1043 - DNA, 100 bp, Artificial Sequence
  Description of Artificial Sequence: Synthetic polynucleotide
tgagggtgttgccaaaggagattaacatttttttttttcttctgcgacagagtcttgctctgtcgcccaggctggagtgcagtggtgcgaccttggctca

SEQ ID NO: 1044 - DNA, 100 bp, Artificial Sequence
  Description of Artificial Sequence: Synthetic polynucleotide
cttggaaggtgtggagggagttgcaggtggttttatatatactattcagggtgaatatgagaagggcgtagaccatctgacaaatgcaattgctgtgtgt

SEQ ID NO: 1045 - DNA, 50 bp, Artificial Sequence
  Description of Artificial Sequence: Synthetic oligonucleotide
agggagttgcaggtggttttatatatactattcagggtgaatatgagaag

SEQ ID NO: 1046 - DNA, 50 bp, Artificial Sequence
  Description of Artificial Sequence: Synthetic oligonucleotide
tgcaggtggttttatatatactattcagggtgaatatgagaagggcgtag

SEQ ID NO: 1047 - DNA, 50 bp, Artificial Sequence; identical to SEQ ID NO: 1046
  Description of Artificial Sequence: Synthetic oligonucleotide

SEQ ID NO: 1048 - DNA, 100 bp, Artificial Sequence
  Description of Artificial Sequence: Synthetic polynucleotide
cttggaaggtgtggagggagttgcaggtggttttatatatactattcaggaaggtgatgctctcttacacaaccttcattctcgccctcaaagacttatt

SEQ ID NO: 1049 - DNA, 100 bp, Artificial Sequence
  Description of Artificial Sequence: Synthetic polynucleotide
gaagttcttccttgaagaaatacagcttggtgaagagttactagctcaaggtgaatatgagaagggcgtagaccatctgacaaatgcaattgctgtgtgt

SEQ ID NO: 1050 - DNA, 100 bp, Artificial Sequence
  Description of Artificial Sequence: Synthetic polynucleotide
cttggaaggtgtggagggagttgcaggtggttttatatatactattcagggtaagtttgctagttgaaacttgaaaagtacactgaatgtcttacactta

SEQ ID NO: 1051 - DNA, 100 bp, Artificial Sequence
  Description of Artificial Sequence: Synthetic polynucleotide
caaaggccaaggcttttcaggttacatgtaattttatgtaaatcttacaggtgaatatgagaagggcgtagaccatctgacaaatgcaattgctgtgtgt

SEQ ID NO: 1052 - DNA, 100 bp, Artificial Sequence
  Description of Artificial Sequence: Synthetic polynucleotide
tctctgaaaccaaatgaccaaatcttggctgaagacaaacacaaggaactgtcactggaaggactgagcgcattcaggagcctggaggaactcatcttgg

SEQ ID NO: 1053 - DNA, 50 bp, Artificial Sequence
  Description of Artificial Sequence: Synthetic oligonucleotide
tggctgaagacaaacacaaggaactgtcactggaaggactgagcgcattc

SEQ ID NO: 1054 - DNA, 47 bp, Artificial Sequence
  Description of Artificial Sequence: Synthetic oligonucleotide
ggctgaagacaaacacaaggaactgtcactggaaggactgagcgcat

SEQ ID NO: 1055 - DNA, 49 bp, Artificial Sequence
  Description of Artificial Sequence: Synthetic oligonucleotide
ctgaagacaaacacaaggaactgtcactggaaggactgagcgcattcag

SEQ ID NO: 1056 - DNA, 49 bp, Artificial Sequence; identical to SEQ ID NO: 1055
  Description of Artificial Sequence: Synthetic oligonucleotide

SEQ ID NO: 1057 - DNA, 49 bp, Artificial Sequence; identical to SEQ ID NO: 1055
  Description of Artificial Sequence: Synthetic oligonucleotide

SEQ ID NO: 1058 - DNA, 49 bp, Artificial Sequence; identical to SEQ ID NO: 1055
  Description of Artificial Sequence: Synthetic oligonucleotide

SEQ ID NO: 1059 - DNA, 100 bp, Artificial Sequence
  Description of Artificial Sequence: Synthetic polynucleotide
tctctgaaaccaaatgaccaaatcttggctgaagacaaacacaaggaactgtttgatgaacttgtgaaaaaattcaaagtcgaatatcatgctggtggct

SEQ ID NO: 1060 - DNA, 50 bp, Artificial Sequence
  Description of Artificial Sequence: Synthetic oligonucleotide
tggctgaagacaaacacaaggaactgtttgatgaacttgtgaaaaaattc

SEQ ID NO: 1061 - DNA, 50 bp, Artificial Sequence; identical to SEQ ID NO: 1060
  Description of Artificial Sequence: Synthetic oligonucleotide

SEQ ID NO: 1062 - DNA, 50 bp, Artificial Sequence; identical to SEQ ID NO: 1060
  Description of Artificial Sequence: Synthetic oligonucleotide

SEQ ID NO: 1063 - DNA, 50 bp, Artificial Sequence; identical to SEQ ID NO: 1060
  Description of Artificial Sequence: Synthetic oligonucleotide

SEQ ID NO: 1064 - DNA, 50 bp, Artificial Sequence; identical to SEQ ID NO: 1060
  Description of Artificial Sequence: Synthetic oligonucleotide

SEQ ID NO: 1065 - DNA, 50 bp, Artificial Sequence; identical to SEQ ID NO: 1060
  Description of Artificial Sequence: Synthetic oligonucleotide

SEQ ID NO: 1066 - DNA, 50 bp, Artificial Sequence; identical to SEQ ID NO: 1060
  Description of Artificial Sequence: Synthetic oligonucleotide

SEQ ID NO: 1067 - DNA, 50 bp, Artificial Sequence
  Description of Artificial Sequence: Synthetic oligonucleotide
aaggaactgtttgatgaacttgtgaaaaaattcaaagtcgaatatcatgc

SEQ ID NO: 1068 - DNA, 50 bp, Artificial Sequence; identical to SEQ ID NO: 1067
  Description of Artificial Sequence: Synthetic oligonucleotide

SEQ ID NO: 1069 - DNA, 100 bp, Artificial Sequence
  Description of Artificial Sequence: Synthetic polynucleotide
tgaatggaaaagtatttgtcactcagcggcaatcattcttcaaataaaaggtcactggaaggactgagcgcattcaggagcctggaggaactcatcttgg

SEQ ID NO: 1070 - DNA, 100 bp, Artificial Sequence
  Description of Artificial Sequence: Synthetic polynucleotide
tctctgaaaccaaatgaccaaatcttggctgaagacaaacacaaggaactgtaagtgcattaaaccattggttgtaaatagtttactctgtctatgaact

SEQ ID NO: 1071 - DNA, 100 bp, Artificial Sequence
  Description of Artificial Sequence: Synthetic polynucleotide
ctccctgatttagtgcaggatcatttttcctgttgcctttgtcattgcaggtcactggaaggactgagcgcattcaggagcctggaggaactcatcttgg

SEQ ID NO: 1072 - DNA, 100 bp, Artificial Sequence
  Description of Artificial Sequence: Synthetic polynucleotide
cggcttcccgggtgcaacctggcctgctgcagtgggtgaagttttggtagagctgtcctggttccagacggtgggggagtcggcactgagcgtagagccc

SEQ ID NO: 1073 - DNA, 50 bp, Artificial Sequence
  Description of Artificial Sequence: Synthetic oligonucleotide
ggcctgctgcagtgggtgaagttttggtagagctgtcctggttccagacg

SEQ ID NO: 1074 - DNA, 100 bp, Artificial Sequence
  Description of Artificial Sequence: Synthetic polynucleotide
cggcttcccgggtgcaacctggcctgctgcagtgggtgaagttttggtaggcaatttcttgcaaccaccaccgaggccccgaaaagcactggtcgtcagg

SEQ ID NO: 1075 - DNA, 100 bp, Artificial Sequence
  Description of Artificial Sequence: Synthetic polynucleotide
catgcagctccaccacctcgaccccaagactttcaagtgcagagccatagagctgtcctggttccagacggtgggggagtcggcactgagcgtagagccc

SEQ ID NO: 1076 - DNA, 100 bp, Artificial Sequence
  Description of Artificial Sequence: Synthetic polynucleotide
aggcttcccgggtgcaacctggcctgctgcagtgggtgaagttttggtaggtgagtgtcagagtgagccgacccaggccacatcctggcagtggaggcac

SEQ ID NO: 1077 - DNA, 100 bp, Artificial Sequence
  Description of Artificial Sequence: Synthetic polynucleotide
gaggaccctgggggtcctggggcctgcctgactctcttctccacccacagagctgtcctggttccagacggtgggggagtcggcactgagcgtagagccc

SEQ ID NO: 1078 - DNA, 100 bp, Artificial Sequence
  Description of Artificial Sequence: Synthetic polynucleotide
ccccctactatcatggtacttacatttttgtgggctggataataaacaagactgggctggcttagatgaagatgaagatgcacatgtctgggaggataat

SEQ ID NO: 1079 - DNA, 50 bp, Artificial Sequence
  Description of Artificial Sequence: Synthetic oligonucleotide
gtgggctggataataaacaagactgggctggcttagatgaagatgaagat

SEQ ID NO: 1080 - DNA, 50 bp, Artificial Sequence; identical to SEQ ID NO: 1079
  Description of Artificial Sequence: Synthetic oligonucleotide

SEQ ID NO: 1081 - DNA, 50 bp, Artificial Sequence; identical to SEQ ID NO: 1079
  Description of Artificial Sequence: Synthetic oligonucleotide

SEQ ID NO: 1082 - DNA, 100 bp, Artificial Sequence
  Description of Artificial Sequence: Synthetic polynucleotide
ccccctactatcatggtacttacatttttgtgggctggataataaacaagctctacttctgcaggccccatcccttcccagaaagaagaggaaatgactg

SEQ ID NO: 1083 - DNA, 50 bp, Artificial Sequence
  Description of Artificial Sequence: Synthetic oligonucleotide
gtgggctggataataaacaagctctacttctgcaggccccatcccttccc

SEQ ID NO: 1084 - DNA, 50 bp, Artificial Sequence
  Description of Artificial Sequence: Synthetic oligonucleotide
tgggctggataataaacaagctctacttctgcaggccccatcccttccca

SEQ ID NO: 1085 - DNA, 100 bp, Artificial Sequence
  Description of Artificial Sequence: Synthetic polynucleotide
cttaggtctgttagaggaagacgacgagtttgaagagttccctgccgaagactgggctggcttagatgaagatgaagatgcacatgtctgggaggataat

SEQ ID NO: 1086 - DNA, 50 bp, Artificial Sequence
  Description of Artificial Sequence: Synthetic oligonucleotide
gaggaagacgacgagtttgaagagttccctgccgaagactgggctggctt

SEQ ID NO: 1087 - DNA, 50 bp, Artificial Sequence; identical to SEQ ID NO: 1086
  Description of Artificial Sequence: Synthetic oligonucleotide

SEQ ID NO: 1088 - DNA, 50 bp, Artificial Sequence; identical to SEQ ID NO: 1086
  Description of Artificial Sequence: Synthetic oligonucleotide

SEQ ID NO: 1089 - DNA, 50 bp, Artificial Sequence
  Description of Artificial Sequence: Synthetic oligonucleotide
gacgagtttgaagagttccctgccgaagactgggctggcttagatgaaga

SEQ ID NO: 1090 - DNA, 50 bp, Artificial Sequence; identical to SEQ ID NO: 1089
  Description of Artificial Sequence: Synthetic oligonucleotide

SEQ ID NO: 1091 - DNA, 100 bp, Artificial Sequence
  Description of Artificial Sequence: Synthetic polynucleotide
ccccctactatcatggtacttacatttttgtgggctggataataaacaaggtaagtaaattaagtatgaagtattttaaatggtgaagaatactaagaaa

SEQ ID NO: 1092 - DNA, 50 bp, Artificial Sequence
  Description of Artificial Sequence: Synthetic oligonucleotide
tgggctggataataaacaaggtaagtaaattaagtatgaagtattttaaa

SEQ ID NO: 1093 - DNA, 50 bp, Artificial Sequence; identical to SEQ ID NO: 1092
  Description of Artificial Sequence: Synthetic oligonucleotide

SEQ ID NO: 1094 - DNA, 50 bp, Artificial Sequence; identical to SEQ ID NO: 1092
  Description of Artificial Sequence: Synthetic oligonucleotide

SEQ ID NO: 1095 - DNA, 50 bp, Artificial Sequence; identical to SEQ ID NO: 1092
  Description of Artificial Sequence: Synthetic oligonucleotide

SEQ ID NO: 1096 - DNA, 50 bp, Artificial Sequence; identical to SEQ ID NO: 1092
  Description of Artificial Sequence: Synthetic oligonucleotide

SEQ ID NO: 1097 - DNA, 50 bp, Artificial Sequence
  Description of Artificial Sequence: Synthetic oligonucleotide
gggctggataataaacaaggtaagtaaattaagtatgaagtattttaaat

SEQ ID NO: 1098 - DNA, 50 bp, Artificial Sequence; identical to SEQ ID NO: 1097
  Description of Artificial Sequence: Synthetic oligonucleotide

SEQ ID NO: 1099 - DNA, 50 bp, Artificial Sequence; identical to SEQ ID NO: 1097
  Description of Artificial Sequence: Synthetic oligonucleotide

SEQ ID NO: 1100 - DNA, 50 bp, Artificial Sequence; identical to SEQ ID NO: 1097
  Description of Artificial Sequence: Synthetic oligonucleotide

SEQ ID NO: 1101 - DNA, 50 bp, Artificial Sequence; identical to SEQ ID NO: 1097
  Description of Artificial Sequence: Synthetic oligonucleotide

SEQ ID NO: 1102 - DNA, 100 bp, Artificial Sequence
  Description of Artificial Sequence: Synthetic polynucleotide
tggaaataatgtatgagaaatatttagacagcatctgtttctatttttagactgggctggcttagatgaagatgaagatgcacatgtctgggaggataat

SEQ ID NO: 1103 - DNA, 100 bp, Artificial Sequence
  Description of Artificial Sequence: Synthetic polynucleotide
cctgctctacaacgtgcctgcagtggccgaggagattcaggatgaagttggaaggagctcattgccaagttagatcaggcagaaaaggagaaggtggatg

SEQ ID NO: 1104 - DNA, 50 bp, Artificial Sequence
  Description of Artificial Sequence: Synthetic oligonucleotide
gcagtggccgaggagattcaggatgaagttggaaggagctcattgccaag

SEQ ID NO: 1105 - DNA, 100 bp, Artificial Sequence
  Description of Artificial Sequence: Synthetic polynucleotide
cctgctctacaacgtgcctgcagtggccgaggagattcaggatgaagttgatgagctgcttcagaaagagcaaaactattcagatgacgtcttggccaac

SEQ ID NO: 1106 - DNA, 50 bp, Artificial Sequence
  Description of Artificial Sequence: Synthetic oligonucleotide
gcagtggccgaggagattcaggatgaagttgatgagctgcttcagaaaga

SEQ ID NO: 1107 - DNA, 50 bp, Artificial Sequence; identical to SEQ ID NO: 1106
  Description of Artificial Sequence: Synthetic oligonucleotide

SEQ ID NO: 1108 - DNA, 50 bp, Artificial Sequence; identical to SEQ ID NO: 1106
  Description of Artificial Sequence: Synthetic oligonucleotide

SEQ ID NO: 1109 - DNA, 50 bp, Artificial Sequence; identical to SEQ ID NO: 1106
  Description of Artificial Sequence: Synthetic oligonucleotide

SEQ ID NO: 1110 - DNA, 50 bp, Artificial Sequence; identical to SEQ ID NO: 1106
  Description of Artificial Sequence: Synthetic oligonucleotide

SEQ ID NO: 1111 - DNA, 50 bp, Artificial Sequence; identical to SEQ ID NO: 1106
  Description of Artificial Sequence: Synthetic oligonucleotide

SEQ ID NO: 1112 - DNA, 50 bp, Artificial Sequence; identical to SEQ ID NO: 1106
  Description of Artificial Sequence: Synthetic oligonucleotide

SEQ ID NO: 1113 - DNA, 50 bp, Artificial Sequence; identical to SEQ ID NO: 1106
  Description of Artificial Sequence: Synthetic oligonucleotide

SEQ ID NO: 1114 - DNA, 50 bp, Artificial Sequence; identical to SEQ ID NO: 1106
  Description of Artificial Sequence: Synthetic oligonucleotide

SEQ ID NO: 1115 - DNA, 50 bp, Artificial Sequence; identical to SEQ ID NO: 1106
  Description of Artificial Sequence: Synthetic oligonucleotide

SEQ ID NO: 1116 - DNA, 50 bp, Artificial Sequence; identical to SEQ ID NO: 1106
  Description of Artificial Sequence: Synthetic oligonucleotide

SEQ ID NO: 1117 - DNA, 50 bp, Artificial Sequence; identical to SEQ ID NO: 1106
  Description of Artificial Sequence: Synthetic oligonucleotide

SEQ ID NO: 1118 - DNA, 50 bp, Artificial Sequence; identical to SEQ ID NO: 1106
  Description of Artificial Sequence: Synthetic oligonucleotide

SEQ ID NO: 1119 - DNA, 50 bp, Artificial Sequence; identical to SEQ ID NO: 1106
  Description of Artificial Sequence: Synthetic oligonucleotide

SEQ ID NO: 1120 - DNA, 50 bp, Artificial Sequence
  Description of Artificial Sequence: Synthetic oligonucleotide
gcagtggccgaggagattcaggatgaagttgatgagctgctttagaaaga

SEQ ID NO: 1121 - DNA, 50 bp, Artificial Sequence; identical to SEQ ID NO: 1106
  Description of Artificial Sequence: Synthetic oligonucleotide

SEQ ID NO: 1122 - DNA, 50 bp, Artificial Sequence
  Description of Artificial Sequence: Synthetic oligonucleotide
cagtggccgaggagattcaggatgaagttgatgagctgcttcagaaagag

SEQ ID NO: 1123 - DNA, 50 bp, Artificial Sequence; identical to SEQ ID NO: 1122
  Description of Artificial Sequence: Synthetic oligonucleotide

SEQ ID NO: 1124 - DNA, 50 bp, Artificial Sequence; identical to SEQ ID NO: 1122
  Description of Artificial Sequence: Synthetic oligonucleotide

SEQ ID NO: 1125 - DNA, 50 bp, Artificial Sequence; identical to SEQ ID NO: 1122
  Description of Artificial Sequence: Synthetic oligonucleotide

SEQ ID NO: 1126 - DNA, 50 bp, Artificial Sequence; identical to SEQ ID NO: 1122
  Description of Artificial Sequence: Synthetic oligonucleotide

SEQ ID NO: 1127 - DNA, 50 bp, Artificial Sequence; identical to SEQ ID NO: 1122
  Description of Artificial Sequence: Synthetic oligonucleotide

SEQ ID NO: 1128 - DNA, 50 bp, Artificial Sequence; identical to SEQ ID NO: 1122
  Description of Artificial Sequence: Synthetic oligonucleotide

SEQ ID NO: 1129 - DNA, 50 bp, Artificial Sequence; identical to SEQ ID NO: 1122
  Description of Artificial Sequence: Synthetic oligonucleotide

SEQ ID NO: 1130 - DNA, 50 bp, Artificial Sequence; identical to SEQ ID NO: 1122
  Description of Artificial Sequence: Synthetic oligonucleotide

SEQ ID NO: 1131 - DNA, 50 bp, Artificial Sequence; identical to SEQ ID NO: 1122
  Description of Artificial Sequence: Synthetic oligonucleotide

SEQ ID NO: 1132 - DNA, 50 bp, Artificial Sequence; identical to SEQ ID NO: 1122
  Description of Artificial Sequence: Synthetic oligonucleotide

SEQ ID NO: 1133 - DNA, 50 bp, Artificial Sequence; identical to SEQ ID NO: 1122
  Description of Artificial Sequence: Synthetic oligonucleotide

SEQ ID NO: 1134 - DNA, 50 bp, Artificial Sequence
  Description of Artificial Sequence: Synthetic oligonucleotide
agtggccgaggagattcaggatgaagttgatgagctgcttcagaaagagc

SEQ ID NO: 1135 - DNA, 50 bp, Artificial Sequence
  Description of Artificial Sequence: Synthetic oligonucleotide
agtggccgaggagattcaggatgaagttgatgagctgctttagaaagagc

SEQ ID NO: 1136 - DNA, 50 bp, Artificial Sequence; identical to SEQ ID NO: 1134
  Description of Artificial Sequence: Synthetic oligonucleotide

SEQ ID NO: 1137 - DNA, 50 bp, Artificial Sequence; identical to SEQ ID NO: 1134
  Description of Artificial Sequence: Synthetic oligonucleotide

SEQ ID NO: 1138 - DNA, 50 bp, Artificial Sequence; identical to SEQ ID NO: 1134
  Description of Artificial Sequence: Synthetic oligonucleotide

SEQ ID NO: 1139 - DNA, 50 bp, Artificial Sequence; identical to SEQ ID NO: 1134
  Description of Artificial Sequence: Synthetic oligonucleotide

SEQ ID NO: 1140 - DNA, 50 bp, Artificial Sequence; identical to SEQ ID NO: 1134
  Description of Artificial Sequence: Synthetic oligonucleotide

SEQ ID NO: 1141 - DNA, 50 bp, Artificial Sequence; identical to SEQ ID NO: 1134
  Description of Artificial Sequence: Synthetic oligonucleotide

SEQ ID NO: 1142 - DNA, 50 bp, Artificial Sequence; identical to SEQ ID NO: 1134
  Description of Artificial Sequence: Synthetic oligonucleotide

SEQ ID NO: 1143 - DNA, 50 bp, Artificial Sequence; identical to SEQ ID NO: 1134
  Description of Artificial Sequence: Synthetic oligonucleotide

SEQ ID NO: 1144 - DNA, 50 bp, Artificial Sequence; identical to SEQ ID NO: 1134
  Description of Artificial Sequence: Synthetic oligonucleotide

SEQ ID NO: 1145 - DNA, 50 bp, Artificial Sequence; identical to SEQ ID NO: 1134
  Description of Artificial Sequence: Synthetic oligonucleotide

SEQ ID NO: 1146 - DNA, 50 bp, Artificial Sequence; identical to SEQ ID NO: 1134
  Description of Artificial Sequence: Synthetic oligonucleotide

SEQ ID NO: 1147 - DNA, 50 bp, Artificial Sequence; identical to SEQ ID NO: 1134
  Description of Artificial Sequence: Synthetic oligonucleotide

SEQ ID NO: 1148 - DNA, 48 bp, Artificial Sequence
  Description of Artificial Sequence: Synthetic oligonucleotide
agtggccgaggagattcaggatgaagttgatgagctgcttcagaaaga

SEQ ID NO: 1149 - DNA, 49 bp, Artificial Sequence
  Description of Artificial Sequence: Synthetic oligonucleotide
agtggccgaggagattcaggatgaagttgatgagctgcttcagaaagag

SEQ ID NO: 1150 - DNA, 50 bp, Artificial Sequence; identical to SEQ ID NO: 1134
  Description of Artificial Sequence: Synthetic oligonucleotide

SEQ ID NO: 1151 - DNA, 50 bp, Artificial Sequence; identical to SEQ ID NO: 1135
  Description of Artificial Sequence: Synthetic oligonucleotide

SEQ ID NO: 1152 - DNA, 50 bp, Artificial Sequence; identical to SEQ ID NO: 1134
  Description of Artificial Sequence: Synthetic oligonucleotide

SEQ ID NO: 1153 - DNA, 50 bp, Artificial Sequence; identical to SEQ ID NO: 1134
  Description of Artificial Sequence: Synthetic oligonucleotide

SEQ ID NO: 1154 - DNA, 50 bp, Artificial Sequence; identical to SEQ ID NO: 1134
  Description of Artificial Sequence: Synthetic oligonucleotide

SEQ ID NO: 1155 - DNA, 50 bp, Artificial Sequence; identical to SEQ ID NO: 1135
  Description of Artificial Sequence: Synthetic oligonucleotide

SEQ ID NO: 1156 - DNA, 50 bp, Artificial Sequence; identical to SEQ ID NO: 1134
  Description of Artificial Sequence: Synthetic oligonucleotide

SEQ ID NO: 1157 - DNA, 50 bp, Artificial Sequence
  Description of Artificial Sequence: Synthetic oligonucleotide
gtggccgaggagattcaggatgaagttgatgagctgcttcagaaagagca

SEQ ID NO: 1158 - DNA, 49 bp, Artificial Sequence
  Description of Artificial Sequence: Synthetic oligonucleotide
gtggccgaggagattcaggatgaagttgatgagctgcttcagaaagagc

SEQ ID NO: 1159 - DNA, 50 bp, Artificial Sequence; identical to SEQ ID NO: 1157
  Description of Artificial Sequence: Synthetic oligonucleotide

SEQ ID NO: 1160 - DNA, 49 bp, Artificial Sequence; identical to SEQ ID NO: 1158
  Description of Artificial Sequence: Synthetic oligonucleotide

SEQ ID NO: 1161 - DNA, 50 bp, Artificial Sequence; identical to SEQ ID NO: 1157
  Description of Artificial Sequence: Synthetic oligonucleotide

SEQ ID NO: 1162 - DNA, 49 bp, Artificial Sequence; identical to SEQ ID NO: 1158
  Description of Artificial Sequence: Synthetic oligonucleotide

SEQ ID NO: 1163 - DNA, 50 bp, Artificial Sequence; identical to SEQ ID NO: 1157
  Description of Artificial Sequence: Synthetic oligonucleotide

SEQ ID NO: 1164 - DNA, 50 bp, Artificial Sequence; identical to SEQ ID NO: 1157
  Description of Artificial Sequence: Synthetic oligonucleotide

SEQ ID NO: 1165 - DNA, 50 bp, Artificial Sequence; identical to SEQ ID NO: 1157
  Description of Artificial Sequence: Synthetic oligonucleotide

SEQ ID NO: 1166 - DNA, 50 bp, Artificial Sequence; identical to SEQ ID NO: 1157
  Description of Artificial Sequence: Synthetic oligonucleotide

SEQ ID NO: 1167 - DNA, 50 bp, Artificial Sequence; identical to SEQ ID NO: 1157
  Description of Artificial Sequence: Synthetic oligonucleotide

SEQ ID NO: 1168 - DNA, 50 bp, Artificial Sequence; identical to SEQ ID NO: 1157
  Description of Artificial Sequence: Synthetic oligonucleotide

SEQ ID NO: 1169 - DNA, 50 bp, Artificial Sequence; identical to SEQ ID NO: 1157
  Description of Artificial Sequence: Synthetic oligonucleotide

SEQ ID NO: 1170 - DNA, 50 bp, Artificial Sequence; identical to SEQ ID NO: 1157
  Description of Artificial Sequence: Synthetic oligonucleotide

SEQ ID NO: 1171 - DNA, 48 bp, Artificial Sequence
  Description of Artificial Sequence: Synthetic oligonucleotide
gtggccgaggagattcaggatgaagttgatgagctgcttcagaaagag

SEQ ID NO: 1172 - DNA, 50 bp, Artificial Sequence; identical to SEQ ID NO: 1157
  Description of Artificial Sequence: Synthetic oligonucleotide

SEQ ID NO: 1173 - DNA, 50 bp, Artificial Sequence; identical to SEQ ID NO: 1157
  Description of Artificial Sequence: Synthetic oligonucleotide

SEQ ID NO: 1174 - DNA, 50 bp, Artificial Sequence; identical to SEQ ID NO: 1157
  Description of Artificial Sequence: Synthetic oligonucleotide

SEQ ID NO: 1175 - DNA, 49 bp, Artificial Sequence; identical to SEQ ID NO: 1158
  Description of Artificial Sequence: Synthetic oligonucleotide

SEQ ID NO: 1176 - DNA, 50 bp, Artificial Sequence; identical to SEQ ID NO: 1157
  Description of Artificial Sequence: Synthetic oligonucleotide

SEQ ID NO: 1177 - DNA, 50 bp, Artificial Sequence; identical to SEQ ID NO: 1157
  Description of Artificial Sequence: Synthetic oligonucleotide

SEQ ID NO: 1178 - DNA, 48 bp, Artificial Sequence; identical to SEQ ID NO: 1171
  Description of Artificial Sequence: Synthetic oligonucleotide

SEQ ID NO: 1179 - DNA, 50 bp, Artificial Sequence; identical to SEQ ID NO: 1157
  Description of Artificial Sequence: Synthetic oligonucleotide

SEQ ID NO: 1180 - DNA, 50 bp, Artificial Sequence; identical to SEQ ID NO: 1157
  Description of Artificial Sequence: Synthetic oligonucleotide

SEQ ID NO: 1181 - DNA, 49 bp, Artificial Sequence; identical to SEQ ID NO: 1158
  Description of Artificial Sequence: Synthetic oligonucleotide

SEQ ID NO: 1182 - DNA, 49 bp, Artificial Sequence; identical to SEQ ID NO: 1158
  Description of Artificial Sequence: Synthetic oligonucleotide

SEQ ID NO: 1183 - DNA, 50 bp, Artificial Sequence; identical to SEQ ID NO: 1157
  Description of Artificial Sequence: Synthetic oligonucleotide

SEQ ID NO: 1184 - DNA, 50 bp, Artificial Sequence; identical to SEQ ID NO: 1157
  Description of Artificial Sequence: Synthetic oligonucleotide

SEQ ID NO: 1185 - DNA, 50 bp, Artificial Sequence; identical to SEQ ID NO: 1157
  Description of Artificial Sequence: Synthetic oligonucleotide

SEQ ID NO: 1186 - DNA, 48 bp, Artificial Sequence; identical to SEQ ID NO: 1171
  Description of Artificial Sequence: Synthetic oligonucleotide

SEQ ID NO: 1187 - DNA, 49 bp, Artificial Sequence; identical to SEQ ID NO: 1158
  Description of Artificial Sequence: Synthetic oligonucleotide

SEQ ID NO: 1188 - DNA, 50 bp, Artificial Sequence; identical to SEQ ID NO: 1157
  Description of Artificial Sequence: Synthetic oligonucleotide

SEQ ID NO: 1189 - DNA, 49 bp, Artificial Sequence; identical to SEQ ID NO: 1158
  Description of Artificial Sequence: Synthetic oligonucleotide

SEQ ID NO: 1190 - DNA, 50 bp, Artificial Sequence; identical to SEQ ID NO: 1157
  Description of Artificial Sequence: Synthetic oligonucleotide

SEQ ID NO: 1191 - DNA, 50 bp, Artificial Sequence; identical to SEQ ID NO: 1157
  Description of Artificial Sequence: Synthetic oligonucleotide

SEQ ID NO: 1192 - DNA, 49 bp, Artificial Sequence; identical to SEQ ID NO: 1158
  Description of Artificial Sequence: Synthetic oligonucleotide

SEQ ID NO: 1193 - DNA, 49 bp, Artificial Sequence; identical to SEQ ID NO: 1158
  Description of Artificial Sequence: Synthetic oligonucleotide

SEQ ID NO: 1194 - DNA, 50 bp, Artificial Sequence
  Description of Artificial Sequence: Synthetic oligonucleotide
tggccgaggagattcaggatgaagttgatgagctgcttcagaaagagcaa

SEQ ID NO: 1195 - DNA, 49 bp, Artificial Sequence
  Description of Artificial Sequence: Synthetic oligonucleotide
tggccgaggagattcaggatgaagttgatgagctgcttcagaaagagca

SEQ ID NO: 1196 - DNA, 50 bp, Artificial Sequence
  Description of Artificial Sequence: Synthetic oligonucleotide
tggccgaggagattcaggatgaagttgatgagctgtttcagaaagagcaa

SEQ ID NO: 1197 - DNA, 49 bp, Artificial Sequence; identical to SEQ ID NO: 1195
  Description of Artificial Sequence: Synthetic oligonucleotide

SEQ ID NO: 1198 - DNA, 47 bp, Artificial Sequence
  Description of Artificial Sequence: Synthetic oligonucleotide
tggccgaggagattcaggatgaagttgatgagctgcttcagaaagag

SEQ ID NO: 1199 - DNA, 50 bp, Artificial Sequence; identical to SEQ ID NO: 1194
  Description of Artificial Sequence: Synthetic oligonucleotide

SEQ ID NO: 1200 - DNA, 50 bp, Artificial Sequence; identical to SEQ ID NO: 1194
  Description of Artificial Sequence: Synthetic oligonucleotide

SEQ ID NO: 1201 - DNA, 49 bp, Artificial Sequence; identical to SEQ ID NO: 1195
  Description of Artificial Sequence: Synthetic oligonucleotide

SEQ ID NO: 1202 - DNA, 49 bp, Artificial Sequence; identical to SEQ ID NO: 1195
  Description of Artificial Sequence: Synthetic oligonucleotide

SEQ ID NO: 1203 - DNA, 50 bp, Artificial Sequence; identical to SEQ ID NO: 1194
  Description of Artificial Sequence: Synthetic oligonucleotide

SEQ ID NO: 1204 - DNA, 50 bp, Artificial Sequence; identical to SEQ ID NO: 1194
  Description of Artificial Sequence: Synthetic oligonucleotide

SEQ ID NO: 1205 - DNA, 49 bp, Artificial Sequence; identical to SEQ ID NO: 1195
  Description of Artificial Sequence: Synthetic oligonucleotide

SEQ ID NO: 1206 - DNA, 49 bp, Artificial Sequence; identical to SEQ ID NO: 1195
  Description of Artificial Sequence: Synthetic oligonucleotide

SEQ ID NO: 1207 - DNA, 49 bp, Artificial Sequence; identical to SEQ ID NO: 1195
  Description of Artificial Sequence: Synthetic oligonucleotide

SEQ ID NO: 1208 - DNA, 50 bp, Artificial Sequence; identical to SEQ ID NO: 1196
  Description of Artificial Sequence: Synthetic oligonucleotide

SEQ ID NO: 1209 - DNA, 50 bp, Artificial Sequence; identical to SEQ ID NO: 1194
  Description of Artificial Sequence: Synthetic oligonucleotide

SEQ ID NO: 1210 - DNA, 50 bp, Artificial Sequence; identical to SEQ ID NO: 1196
  Description of Artificial Sequence: Synthetic oligonucleotide

SEQ ID NO: 1211 - DNA, 50 bp, Artificial Sequence
  Description of Artificial Sequence: Synthetic oligonucleotide
ggccgaggagattcaggatgaagttgatgagctgcttcagaaagagcaaa

SEQ ID NO: 1212 - DNA, 50 bp, Artificial Sequence; identical to SEQ ID NO: 1211
  Description of Artificial Sequence: Synthetic oligonucleotide

SEQ ID NO: 1213 - DNA, 50 bp, Artificial Sequence; identical to SEQ ID NO: 1211
  Description of Artificial Sequence: Synthetic oligonucleotide

SEQ ID NO: 1214 - DNA, 50 bp, Artificial Sequence; identical to SEQ ID NO: 1211
  Description of Artificial Sequence: Synthetic oligonucleotide

SEQ ID NO: 1215 - DNA, 50 bp, Artificial Sequence; identical to SEQ ID NO: 1211
  Description of Artificial Sequence: Synthetic oligonucleotide

SEQ ID NO: 1216 - DNA, 50 bp, Artificial Sequence; identical to SEQ ID NO: 1211
  Description of Artificial Sequence: Synthetic oligonucleotide

SEQ ID NO: 1217 - DNA, 50 bp, Artificial Sequence; identical to SEQ ID NO: 1211
  Description of Artificial Sequence: Synthetic oligonucleotide

SEQ ID NO: 1218 - DNA, 50 bp, Artificial Sequence; identical to SEQ ID NO: 1211
  Description of Artificial Sequence: Synthetic oligonucleotide

SEQ ID NO: 1219 - DNA, 50 bp, Artificial Sequence
  Description of Artificial Sequence: Synthetic oligonucleotide
ggccgaggagattcaggttgaagttgatgagctgcttcagaaagagcaaa

SEQ ID NO: 1220 - DNA, 50 bp, Artificial Sequence; identical to SEQ ID NO: 1211
  Description of Artificial Sequence: Synthetic oligonucleotide

SEQ ID NO: 1221 - DNA, 50 bp, Artificial Sequence; identical to SEQ ID NO: 1211
  Description of Artificial Sequence: Synthetic oligonucleotide

SEQ ID NO: 1222 - DNA, 50 bp, Artificial Sequence; identical to SEQ ID NO: 1211
  Description of Artificial Sequence: Synthetic oligonucleotide

SEQ ID NO: 1223 - DNA, 50 bp, Artificial Sequence; identical to SEQ ID NO: 1211
  Description of Artificial Sequence: Synthetic oligonucleotide

SEQ ID NO: 1224 - DNA, 50 bp, Artificial Sequence; identical to SEQ ID NO: 1211
  Description of Artificial Sequence: Synthetic oligonucleotide

SEQ ID NO: 1225 - DNA, 50 bp, Artificial Sequence
  Description of Artificial Sequence: Synthetic oligonucleotide
  modified_base (17)..(17): a, c, t, g, unknown or other
ggccgaggagattcagnatgaagttgatgagctgcttcagaaagagcaaa

SEQ ID NO: 1226 - DNA, 50 bp, Artificial Sequence; identical to SEQ ID NO: 1211
  Description of Artificial Sequence: Synthetic oligonucleotide

SEQ ID NO: 1227 - DNA, 50 bp, Artificial Sequence; identical to SEQ ID NO: 1211
  Description of Artificial Sequence: Synthetic oligonucleotide

SEQ ID NO: 1228 - DNA, 50 bp, Artificial Sequence; identical to SEQ ID NO: 1211
  Description of Artificial Sequence: Synthetic oligonucleotide

SEQ ID NO: 1229 - DNA, 50 bp, Artificial Sequence; identical to SEQ ID NO: 1211
  Description of Artificial Sequence: Synthetic oligonucleotide

SEQ ID NO: 1230 - DNA, 50 bp, Artificial Sequence; identical to SEQ ID NO: 1211
  Description of Artificial Sequence: Synthetic oligonucleotide

SEQ ID NO: 1231 - DNA, 50 bp, Artificial Sequence; identical to SEQ ID NO: 1211
  Description of Artificial Sequence: Synthetic oligonucleotide

SEQ ID NO: 1232 - DNA, 50 bp, Artificial Sequence; identical to SEQ ID NO: 1211
  Description of Artificial Sequence: Synthetic oligonucleotide

SEQ ID NO: 1233 - DNA, 50 bp, Artificial Sequence; identical to SEQ ID NO: 1211
  Description of Artificial Sequence: Synthetic oligonucleotide

SEQ ID NO: 1234 - DNA, 47 bp, Artificial Sequence
  Description of Artificial Sequence: Synthetic oligonucleotide
cgaggagattcaggatgaagttgatgagctgcttcagaaagagcaaa

SEQ ID NO: 1235 - DNA, 50 bp, Artificial Sequence
  Description of Artificial Sequence: Synthetic oligonucleotide
gagatttaggatgaagttgatgagctgcttcagaaagagcaaaactattc

SEQ ID NO: 1236 - DNA, 50 bp, Artificial Sequence; identical to SEQ ID NO: 1235
  Description of Artificial Sequence: Synthetic oligonucleotide

SEQ ID NO: 1237 - DNA, 50 bp, Artificial Sequence
  Description of Artificial Sequence: Synthetic oligonucleotide
attcaggatgaagttgatgagctgcttcagaaagagcaaaactattcaga

SEQ ID NO: 1238 - DNA, 50 bp, Artificial Sequence; identical to SEQ ID NO: 1237
  Description of Artificial Sequence: Synthetic oligonucleotide

SEQ ID NO: 1239 - DNA, 100 bp, Artificial Sequence
  Description of Artificial Sequence: Synthetic polynucleotide
gaagaataccatgaggtcaaaaaggaaatcaccctgcttgagcaaaggaagaaggagctcattgccaagttagatcaggcagaaaaggagaaggtggatg

SEQ ID NO: 1240 - DNA, 100 bp, Artificial Sequence
  Description of Artificial Sequence: Synthetic polynucleotide
cctgctctacaacgtgcctgcagtggccgaggagattcaggatgaagttggtaagtaagctgttcttttgatgctgcacatggacatgtattttccccca

SEQ ID NO: 1241 - DNA, 50 bp, Artificial Sequence
  Description of Artificial Sequence: Synthetic oligonucleotide
cagtggccgaggagattcaggatgaagttggtaagtaagctgttcttttg

SEQ ID NO: 1242 - DNA, 50 bp, Artificial Sequence
  Description of Artificial Sequence: Synthetic oligonucleotide
agtggccgaggagattcaggatgaagttggtaagtaagctgttcttttga

SEQ ID NO: 1243 - DNA, 50 bp, Artificial Sequence; identical to SEQ ID NO: 1242
  Description of Artificial Sequence: Synthetic oligonucleotide

SEQ ID NO: 1244 - DNA, 50 bp, Artificial Sequence; identical to SEQ ID NO: 1242
  Description of Artificial Sequence: Synthetic oligonucleotide

SEQ ID NO: 1245 - DNA, 50 bp, Artificial Sequence; identical to SEQ ID NO: 1242
  Description of Artificial Sequence: Synthetic oligonucleotide

SEQ ID NO: 1246 - DNA, 49 bp, Artificial Sequence
  Description of Artificial Sequence: Synthetic oligonucleotide
agtggccgaggagattcaggatgaagttggtaagtaagctgttcttttg

SEQ ID NO: 1247 - DNA, 50 bp, Artificial Sequence; identical to SEQ ID NO: 1242
  Description of Artificial Sequence: Synthetic oligonucleotide

SEQ ID NO: 1248 - DNA, 50 bp, Artificial Sequence
  Description of Artificial Sequence: Synthetic oligonucleotide
agtggccgaggagattcaggatgaagttggtaagtaagctgatcttttga

SEQ ID NO: 1249 - DNA, 50 bp, Artificial Sequence
  Description of Artificial Sequence: Synthetic oligonucleotide
tggccgaggagattcaggatgaagttggtaagtaagctgttcttttgatg

SEQ ID NO: 1250 - DNA, 50 bp, Artificial Sequence; identical to SEQ ID NO: 1249
  Description of Artificial Sequence: Synthetic oligonucleotide

SEQ ID NO: 1251 - DNA, 50 bp, Artificial Sequence; identical to SEQ ID NO: 1249
  Description of Artificial Sequence: Synthetic oligonucleotide

SEQ ID NO: 1252 - DNA, 50 bp, Artificial Sequence; identical to SEQ ID NO: 1249
  Description of Artificial Sequence: Synthetic oligonucleotide

SEQ ID NO: 1253 - DNA, 50 bp, Artificial Sequence; identical to SEQ ID NO: 1249
  Description of Artificial Sequence: Synthetic oligonucleotide

SEQ ID NO: 1254 - DNA, 50 bp, Artificial Sequence
  Description of Artificial Sequence: Synthetic oligonucleotide
ggccgaggagattcaggatgaagttggtaagtaagctgttcttttgatgc

SEQ ID NO: 1255 - DNA, 50 bp, Artificial Sequence; identical to SEQ ID NO: 1254
  Description of Artificial Sequence: Synthetic oligonucleotide

SEQ ID NO: 1256 - DNA, 100 bp, Artificial Sequence
  Description of Artificial Sequence: Synthetic polynucleotide
gcttgcattgaattctgtgcttcttcctgccctttaccccgaatcttcaggaaggagctcattgccaagttagatcaggcagaaaaggagaaggtggatg

SEQ ID NO: 1257 - DNA, 100 bp, Artificial Sequence
  Description of Artificial Sequence: Synthetic polynucleotide
gagaagctgccgccgaacgacaggacgttggggcggcctggctccctcaggaatggaagattgcgaaacaatggaagatgtatacatggcttcagtagaa

SEQ ID NO: 1258 - DNA, 50 bp, Artificial Sequence
  Description of Artificial Sequence: Synthetic oligonucleotide
ggggcggcctggctccctcaggaatggaagattgcgaaacaatggaagat

SEQ ID NO: 1259 - DNA, 50 bp, Artificial Sequence
  Description of Artificial Sequence: Synthetic oligonucleotide
ggctccctcaggaatggaagattgcgaaacaatggaagatgtatacatgg

SEQ ID NO: 1260 - DNA, 50 bp, Artificial Sequence; identical to SEQ ID NO: 1259
  Description of Artificial Sequence: Synthetic oligonucleotide

SEQ ID NO: 1261 - DNA, 50 bp, Artificial Sequence; identical to SEQ ID NO: 1259
  Description of Artificial Sequence: Synthetic oligonucleotide

SEQ ID NO: 1262 - DNA, 50 bp, Artificial Sequence; identical to SEQ ID NO: 1259
  Description of Artificial Sequence: Synthetic oligonucleotide

SEQ ID NO: 1263 - DNA, 50 bp, Artificial Sequence; identical to SEQ ID NO: 1259
  Description of Artificial Sequence: Synthetic oligonucleotide

SEQ ID NO: 1264 - DNA, 100 bp, Artificial Sequence
  Description of Artificial Sequence: Synthetic polynucleotide
gagaagctgccgccgaacgacaggacgttggggcggcctggctccctcaggtttaagaattgtttaagctgcatcaatggagcacatacagggagcttgg

SEQ ID NO: 1265 - DNA, 50 bp, Artificial Sequence
  Description of Artificial Sequence: Synthetic oligonucleotide
ggacgttggggcggcctggctccctcaggtttaagaattgtttaagctgc

SEQ ID NO: 1266 - DNA, 50 bp, Artificial Sequence
  Description of Artificial Sequence: Synthetic oligonucleotide
tggggcggcctggctccctcaggtttaagaattgtttaagctgcatcaat

SEQ ID NO: 1267 - DNA, 50 bp, Artificial Sequence; identical to SEQ ID NO: 1266
  Description of Artificial Sequence: Synthetic oligonucleotide

SEQ ID NO: 1268 - DNA, 50 bp, Artificial Sequence; identical to SEQ ID NO: 1266
  Description of Artificial Sequence: Synthetic oligonucleotide

SEQ ID NO: 1269 - DNA, 50 bp, Artificial Sequence
  Description of Artificial Sequence: Synthetic oligonucleotide
tggggcggcctggctccctcaggtttaagaattgtttaagctgcaccaat

SEQ ID NO: 1270 - DNA, 50 bp, Artificial Sequence; identical to SEQ ID NO: 1269
  Description of Artificial Sequence: Synthetic oligonucleotide

SEQ ID NO: 1271 - DNA, 50 bp, Artificial Sequence
  Description of Artificial Sequence: Synthetic oligonucleotide
ggggcggcctggctccctcaggtttaagaattgtttaagctgcatcaatg

SEQ ID NO: 1272 - DNA, 50 bp, Artificial Sequence; identical to SEQ ID NO: 1271
  Description of Artificial Sequence: Synthetic oligonucleotide

SEQ ID NO: 1273 - DNA, 50 bp, Artificial Sequence; identical to SEQ ID NO: 1271
  Description of Artificial Sequence: Synthetic oligonucleotide

SEQ ID NO: 1274 - DNA, 50 bp, Artificial Sequence
  Description of Artificial Sequence: Synthetic oligonucleotide
gcggcctggctccctcaggtttaagaattgtttaagctgcatcaatggag

SEQ ID NO: 1275 - DNA, 50 bp, Artificial Sequence
  Description of Artificial Sequence: Synthetic oligonucleotide
ggctccctcaggtttaagaattgtttaagctgcatcaatggagtacatac

SEQ ID NO: 1276 - DNA, 50 bp, Artificial Sequence; identical to SEQ ID NO: 1275
  Description of Artificial Sequence: Synthetic oligonucleotide

SEQ ID NO: 1277 - DNA, 50 bp, Artificial Sequence; identical to SEQ ID NO: 1275
  Description of Artificial Sequence: Synthetic oligonucleotide

SEQ ID NO: 1278 - DNA, 100 bp, Artificial Sequence
  Description of Artificial Sequence: Synthetic polynucleotide
ggggaaaactgcaattttggagcagctcctttatggaaatcatactattggaatggaagattgcgaaacaatggaagatgtatacatggcttcagtagaa

SEQ ID NO: 1279 - DNA, 100 bp, Artificial Sequence
  Description of Artificial Sequence: Synthetic polynucleotide
gagaagctgccgccgaacgacaggacgttggggcggcctggctccctcaggtaggtggcaggaccgggtcgtggatgccgggggagccgggcggcggggc

SEQ ID NO: 1280 - DNA, 100 bp, Artificial Sequence
  Description of Artificial Sequence: Synthetic polynucleotide
cagttgacactgacttagccaaaaagagtaatttgttttcttaatcccaggaatggaagattgcgaaacaatggaagatgtatacatggcttcagtagaa

SEQ ID NO: 1281 - DNA, 100 bp, Artificial Sequence
  Description of Artificial Sequence: Synthetic polynucleotide
gccccgggggcgggccggggtcaccacgcctgccccagggaaccgcacagttctttaaggaaaaacagtagtgctctgcatagtttactgaaacgagtgg

SEQ ID NO: 1282 - DNA, 50 bp, Artificial Sequence
  Description of Artificial Sequence: Synthetic oligonucleotide
gccccagggaaccgcacagttctttaaggaaaaacagtagtgctctgcat

SEQ ID NO: 1283 - DNA, 50 bp, Artificial Sequence; identical to SEQ ID NO: 1282
  Description of Artificial Sequence: Synthetic oligonucleotide

SEQ ID NO: 1284 - DNA, 50 bp, Artificial Sequence; identical to SEQ ID NO: 1282
  Description of Artificial Sequence: Synthetic oligonucleotide

SEQ ID NO: 1285 - DNA, 50 bp, Artificial Sequence; identical to SEQ ID NO: 1282
  Description of Artificial Sequence: Synthetic oligonucleotide

SEQ ID NO: 1286 - DNA, 50 bp, Artificial Sequence; identical to SEQ ID NO: 1282
  Description of Artificial Sequence: Synthetic oligonucleotide

SEQ ID NO: 1287 - DNA, 50 bp, Artificial Sequence; identical to SEQ ID NO: 1282
  Description of Artificial Sequence: Synthetic oligonucleotide

SEQ ID NO: 1288 - DNA, 50 bp, Artificial Sequence; identical to SEQ ID NO: 1282
  Description of Artificial Sequence: Synthetic oligonucleotide

SEQ ID NO: 1289 - DNA, 50 bp, Artificial Sequence; identical to SEQ ID NO: 1282
  Description of Artificial Sequence: Synthetic oligonucleotide

SEQ ID NO: 1290 - DNA, 50 bp, Artificial Sequence; identical to SEQ ID NO: 1282
  Description of Artificial Sequence: Synthetic oligonucleotide

SEQ ID NO: 1291 - DNA, 50 bp, Artificial Sequence; identical to SEQ ID NO: 1282
  Description of Artificial Sequence: Synthetic oligonucleotide

SEQ ID NO: 1292 - DNA, 50 bp, Artificial Sequence; identical to SEQ ID NO: 1282
  Description of Artificial Sequence: Synthetic oligonucleotide

SEQ ID NO: 1293 - DNA, 50 bp, Artificial Sequence; identical to SEQ ID NO: 1282
  Description of Artificial Sequence: Synthetic oligonucleotide

SEQ ID NO: 1294 - DNA, 50 bp, Artificial Sequence; identical to SEQ ID NO: 1282
  Description of Artificial Sequence: Synthetic oligonucleotide

SEQ ID NO: 1295 - DNA, 50 bp, Artificial Sequence; identical to SEQ ID NO: 1282
  Description of Artificial Sequence: Synthetic oligonucleotide

SEQ ID NO: 1296 - DNA, 100 bp, Artificial Sequence
  Description of Artificial Sequence: Synthetic polynucleotide
gccccgggggcgggccggggtcaccacgcctgccccagggaaccgcacaggcacgtgcgctaagctgcggctacccccgcaagcaaccttccaagtcctt

SEQ ID NO: 1297 - DNA, 100 bp, Artificial Sequence
  Description of Artificial Sequence: Synthetic polynucleotide
acaatgatgtttcttgcagagcatgattatggattatttcatttaaaaagttctttaaggaaaaacagtagtgctctgcatagtttactgaaacgagtgg

SEQ ID NO: 1298 - DNA, 100 bp, Artificial Sequence
  Description of Artificial Sequence: Synthetic polynucleotide
gccccgggggcgggccggggtcaccacgcctgccccagggaaccgcacaggtgagggctggggccgagtggccgcgtgcggggctctgcgcccatttcac

SEQ ID NO: 1299 - DNA, 100 bp, Artificial Sequence
  Description of Artificial Sequence: Synthetic polynucleotide
tatgctcatattttaagataatatcttctctttattttctttatttacagttctttaaggaaaaacagtagtgctctgcatagtttactgaaacgagtgg

SEQ ID NO: 1300 - DNA, 100 bp, Artificial Sequence
  Description of Artificial Sequence: Synthetic polynucleotide
gctgactcgggaggaggacctgatcaagactgatgatgtcctggatctgacaaaaaatcaccatgtaccaacctatccaaacttatccatggatgaatct

SEQ ID NO: 1301 - DNA, 50 bp, Artificial Sequence
  Description of Artificial Sequence: Synthetic oligonucleotide
cgggaggaggacctgatcaagactgatgatgtcccggatctgacaaaaaa

SEQ ID NO: 1302 - DNA, 50 bp, Artificial Sequence
  Description of Artificial Sequence: Synthetic oligonucleotide
cgggaggaggacctgatcaagactgatgatgtcctggatctgacaaaaaa

SEQ ID NO: 1303 - DNA, 50 bp, Artificial Sequence
  Description of Artificial Sequence: Synthetic oligonucleotide
  modified_base (5)..(5): a, c, t, g, unknown or other
cgggnggaggacctgatcaagactgatgatgtcctggatctgacaaaaaa

SEQ ID NO: 1304 - DNA, 50 bp, Artificial Sequence; identical to SEQ ID NO: 1302
  Description of Artificial Sequence: Synthetic oligonucleotide

SEQ ID NO: 1305 - DNA, 50 bp, Artificial Sequence; identical to SEQ ID NO: 1302
  Description of Artificial Sequence: Synthetic oligonucleotide

SEQ ID NO: 1306 - DNA, 50 bp, Artificial Sequence; identical to SEQ ID NO: 1302
  Description of Artificial Sequence: Synthetic oligonucleotide

SEQ ID NO: 1307 - DNA, 50 bp, Artificial Sequence; identical to SEQ ID NO: 1302
  Description of Artificial Sequence: Synthetic oligonucleotide

SEQ ID NO: 1308 - DNA, 50 bp, Artificial Sequence; identical to SEQ ID NO: 1302
  Description of Artificial Sequence: Synthetic oligonucleotide

SEQ ID NO: 1309 - DNA, 50 bp, Artificial Sequence
  Description of Artificial Sequence: Synthetic oligonucleotide
gggaggaggacctgatcaagactgatgatgtcctggatctgacaaaaaat

SEQ ID NO: 1310 - DNA, 50 bp, Artificial Sequence; identical to SEQ ID NO: 1309
  Description of Artificial Sequence: Synthetic oligonucleotide

SEQ ID NO: 1311 - DNA, 50 bp, Artificial Sequence
  Description of Artificial Sequence: Synthetic oligonucleotide
gatgatgtcctggatctgacaaaaaatcaccatgtaccaacctatccaaa

SEQ ID NO: 1312 - DNA, 50 bp, Artificial Sequence
  Description of Artificial Sequence: Synthetic oligonucleotide
gatgtcctggatctgacaaaaaatcaccatgtaccaacctatccaaactt

SEQ ID NO: 1313 - DNA, 50 bp, Artificial Sequence; identical to SEQ ID NO: 1312
  Description of Artificial Sequence: Synthetic oligonucleotide

SEQ ID NO: 1314 - DNA, 100 bp, Artificial Sequence
  Description of Artificial Sequence: Synthetic polynucleotide
gctgactcgggaggaggacctgatcaagactgatgatgtcctggatctgaataacagcgacttgattgcatgtacagtgatcaccaaggatggcggcatg

SEQ ID NO: 1315 - DNA, 50 bp, Artificial Sequence
  Description of Artificial Sequence: Synthetic oligonucleotide
gatcaagactgatgatgtcctggatctgaataacagcgacttgattgcat

SEQ ID NO: 1316 - DNA, 100 bp, Artificial Sequence
  Description of Artificial Sequence: Synthetic polynucleotide
tcaagtgattctcctgcttcagcttcccaagtatctgggactacaggcatcaaaaaatcaccatgtaccaacctatccaaacttatccatggatgaatct

SEQ ID NO: 1317 - DNA, 100 bp, Artificial Sequence
  Description of Artificial Sequence: Synthetic polynucleotide
gctgactcgggaggaggacctgatcaagactgatgatgtcctggatctgagtgagttggctgctctgagtcacagcagggggctgggggacatgggacat

SEQ ID NO: 1318 - DNA, 50 bp, Artificial Sequence
  Description of Artificial Sequence: Synthetic oligonucleotide
gatcaagattgatgatgtcctggatctgagtgagttggctgctctgagtc

SEQ ID NO: 1319 - DNA, 50 bp, Artificial Sequence; identical to SEQ ID NO: 1318
  Description of Artificial Sequence: Synthetic oligonucleotide

SEQ ID NO: 1320 - DNA, 50 bp, Artificial Sequence
  Description of Artificial Sequence: Synthetic oligonucleotide
ctggatctgagtgagttggctgctctgagtcacagcagggggctggggga

SEQ ID NO: 1321 - DNA, 50 bp, Artificial Sequence
  Description of Artificial Sequence: Synthetic oligonucleotide
ggatctgagtgagttggctgctctgagtcacagcagagggctgggggaca

SEQ ID NO: 1322 - DNA, 100 bp, Artificial Sequence
  Description of Artificial Sequence: Synthetic polynucleotide
ctttttgtatttgagctttcatagactttttcttcccttaaccactgcagcaaaaaatcaccatgtaccaacctatccaaacttatccatggatgaatct

SEQ ID NO: 1323 - DNA, 50 bp, Artificial Sequence
  Description of Artificial Sequence: Synthetic oligonucleotide
ccactgcagcaaaaaatcaccatgtaacaacctatccaaacttatccatg

SEQ ID NO: 1324 - DNA, 50 bp, Artificial Sequence
  Description of Artificial Sequence: Synthetic oligonucleotide
ctgcagcaaaaaatcaccatgtaccaacctatccaaacttatccatggat

SEQ ID NO: 1325 - DNA, 50 bp, Artificial Sequence; identical to SEQ ID NO: 1324
  Description of Artificial Sequence: Synthetic oligonucleotide

SEQ ID NO: 1326 - DNA, 100 bp, Artificial Sequence
  Description of Artificial Sequence: Synthetic polynucleotide
acgaggaggaccagaaggagatcggtgacctccgtgcccagcagcagcagtggatgattcaacagccacacaaagcagcaacattttttggatgcattgg

SEQ ID NO: 1327 - DNA, 50 bp, Artificial Sequence
  Description of Artificial Sequence: Synthetic oligonucleotide
agaaggagattggtgacctccgtgcccagcagcagcagtggatgattcaa

SEQ ID NO: 1328 - DNA, 50 bp, Artificial Sequence
  Description of Artificial Sequence: Synthetic oligonucleotide
gtgacctccgtgcccagcagcagcagtggatgattcaacagccacacaaa

SEQ ID NO: 1329 - DNA, 50 bp, Artificial Sequence
  Description of Artificial Sequence: Synthetic oligonucleotide
tgacctccgtgcccagcagcagcagtggatgattcaacagccacacaaag

SEQ ID NO: 1330 - DNA, 50 bp, Artificial Sequence
  Description of Artificial Sequence: Synthetic oligonucleotide
tgacctccgtgcccagcagcagcagtggatgattcaacagccacaaaaag

SEQ ID NO: 1331 - DNA, 50 bp, Artificial Sequence
  Description of Artificial Sequence: Synthetic oligonucleotide
tccgtgcccagcagaagcagtggatgattcaacagccacacaaagcagca

SEQ ID NO: 1332 - DNA, 50 bp, Artificial Sequence
  Description of Artificial Sequence: Synthetic oligonucleotide
ccgtgcccagcagcagcagtggatgattcaacagccacacaaagcagcaa

SEQ ID NO: 1333 - DNA, 50 bp, Artificial Sequence; identical to SEQ ID NO: 1332
  Description of Artificial Sequence: Synthetic oligonucleotide

SEQ ID NO: 1334 - DNA, 50 bp, Artificial Sequence; identical to SEQ ID NO: 1332
  Description of Artificial Sequence: Synthetic oligonucleotide

SEQ ID NO: 1335 - DNA, 50 bp, Artificial Sequence; identical to SEQ ID NO: 1332
  Description of Artificial Sequence: Synthetic oligonucleotide

SEQ ID NO: 1336 - DNA, 50 bp, Artificial Sequence; identical to SEQ ID NO: 1332
  Description of Artificial Sequence: Synthetic oligonucleotide

SEQ ID NO: 1337 - DNA, 50 bp, Artificial Sequence; identical to SEQ ID NO: 1332
  Description of Artificial Sequence: Synthetic oligonucleotide

SEQ ID NO: 1338 - DNA, 50 bp, Artificial Sequence
  Description of Artificial Sequence: Synthetic oligonucleotide
gtgcccagcagcagcagtggatgattcaacagccacacaaagcagcaaca

SEQ ID NO: 1339 - DNA, 50 bp, Artificial Sequence
  Description of Artificial Sequence: Synthetic oligonucleotide
gtgcccagcagcagcagtggatgattcaacagccccacaaagcagcaaca

SEQ ID NO: 1340 - DNA, 50 bp, Artificial Sequence; identical to SEQ ID NO: 1338
  Description of Artificial Sequence: Synthetic oligonucleotide

SEQ ID NO: 1341 - DNA, 50 bp, Artificial Sequence
  Description of Artificial Sequence: Synthetic oligonucleotide
ccagcagcagcagtggatgattcaacagccacacaaagcagcaacatttt

SEQ ID NO: 1342 - DNA, 49 bp, Artificial Sequence
  Description of Artificial Sequence: Synthetic oligonucleotide
agcagtggatgattcaacagccacacaaagcagcaacattttttggatg

SEQ ID NO: 1343 - DNA, 49 bp, Artificial Sequence; identical to SEQ ID NO: 1342
  Description of Artificial Sequence: Synthetic oligonucleotide

SEQ ID NO: 1344 - DNA, 100 bp, Artificial Sequence
  Description of Artificial Sequence: Synthetic polynucleotide
acgaggaggaccagaaggagatcggtgacctccgtgcccagcagcagcaggtgttgaagcacaacgggtcatccgagattctcaacaaactgtatgacac

SEQ ID NO: 1345 - DNA, 50 bp, Artificial Sequence
  Description of Artificial Sequence: Synthetic oligonucleotide
gtgcccagcagcagcaggtgttgaagcacaacgggtcatccgagattctc

SEQ ID NO: 1346 - DNA, 50 bp, Artificial Sequence
  Description of Artificial Sequence: Synthetic oligonucleotide
cagcagcagcaggtgttgaagcacaacgggtcatccgagattctcaacaa

SEQ ID NO: 1347 - DNA, 50 bp, Artificial Sequence
  Description of Artificial Sequence: Synthetic oligonucleotide
gcagcagcaggtgttgaagcacaacgggtcatccgagattcttaacaaac

SEQ ID NO: 1348 - DNA, 50 bp, Artificial Sequence; identical to SEQ ID NO: 1347
  Description of Artificial Sequence: Synthetic oligonucleotide

SEQ ID NO: 1349 - DNA, 50 bp, Artificial Sequence; identical to SEQ ID NO: 1347
  Description of Artificial Sequence: Synthetic oligonucleotide

SEQ ID NO: 1350 - DNA, 50 bp, Artificial Sequence
  Description of Artificial Sequence: Synthetic oligonucleotide
cagcagcaggtgttgaagcacaacgggtcatccgagattctcaacaaact

SEQ ID NO: 1351 - DNA, 50 bp, Artificial Sequence; identical to SEQ ID NO: 1350
  Description of Artificial Sequence: Synthetic oligonucleotide

SEQ ID NO: 1352 - DNA, 50 bp, Artificial Sequence; identical to SEQ ID NO: 1350
  Description of Artificial Sequence: Synthetic oligonucleotide

SEQ ID NO: 1353 - DNA, 100 bp, Artificial Sequence
  Description of Artificial Sequence: Synthetic polynucleotide
tcgaatatcatgctggtggctctacccagaattcaattaaagtggctcagtggatgattcaacagccacacaaagcagcaacattttttggatgcattgg

SEQ ID NO: 1354 - DNA, 100 bp, Artificial Sequence
  Description of Artificial Sequence: Synthetic polynucleotide
acgaggaggaccagaaggagatcggtgacctccgtgcccagcagcagcaggtaggcccagcccctggagactggccatttctcccaagtagtcctcattc

SEQ ID NO: 1355 - DNA, 100 bp, Artificial Sequence
  Description of Artificial Sequence: Synthetic polynucleotide
tgtgtaccatttttttgccccattaaattatttatgttcctgttttacagtggatgattcaacagccacacaaagcagcaacattttttggatgcattgg

SEQ ID NO: 1356 - DNA, 100 bp, Artificial Sequence
  Description of Artificial Sequence: Synthetic polynucleotide
gaaccttcactaccctggtgggaggcccagagtacgtgcactgcctgctgagcgccagagagcaatgggctgcatcgttggtggcaagacttatgctctg

SEQ ID NO: 1357 - DNA, 50 bp, Artificial Sequence
  Description of Artificial Sequence: Synthetic oligonucleotide
ggtgggaggcccagagtacgtgcactgcctgctgagcgccagagagcaat

SEQ ID NO: 1358 - DNA, 50 bp, Artificial Sequence; identical to SEQ ID NO: 1357
  Description of Artificial Sequence: Synthetic oligonucleotide

SEQ ID NO: 1359 - DNA, 50 bp, Artificial Sequence
  Description of Artificial Sequence: Synthetic oligonucleotide
gtgggaggcccagagtacgtgcactgcctgctgagcgccagagagcaatg

SEQ ID NO: 1360 - DNA, 50 bp, Artificial Sequence; identical to SEQ ID NO: 1359
  Description of Artificial Sequence: Synthetic oligonucleotide

SEQ ID NO: 1361 - DNA, 100 bp, Artificial Sequence
  Description of Artificial Sequence: Synthetic polynucleotide
gaaccttcactaccctggtgggaggcccagagtacgtgcactgcctgctgccaccgctggagtcgctggccacagtggaggagacagtggtgcgggacaa

SEQ ID NO: 1362 - DNA, 50 bp, Artificial Sequence
  Description of Artificial Sequence: Synthetic oligonucleotide
gggaggcccagagtacgtgcattgcctgctgccaccgctggagtcgctgg

SEQ ID NO: 1363 - DNA, 100 bp, Artificial Sequence
  Description of Artificial Sequence: Synthetic polynucleotide
aacttcatgaacgtgtggaagctcagctccagctcccatcctggctctgaagcgccagagagcaatgggctgcatcgttggtggcaagacttatgctctg

SEQ ID NO: 1364 - DNA, 100 bp, Artificial Sequence
  Description of Artificial Sequence: Synthetic polynucleotide
gaaccttcactaccctggtgggaggcccagagtacgtgcactgcctgctggtgagtggaaggcaggaagtcctcttgcccaccccttagggtcggcccat

SEQ ID NO: 1365 - DNA, 100 bp, Artificial Sequence
  Description of Artificial Sequence: Synthetic polynucleotide
tttctccagtttaacgaagaggtgttttctctcttctcccttccatgtagagcgccagagagcaatgggctgcatcgttggtggcaagacttatgctctg

SEQ ID NO: 1366 - DNA, 100 bp, Artificial Sequence
  Description of Artificial Sequence: Synthetic polynucleotide
acctgcccgttcaccaactctcctccccattctatacaaaaacaacaaaaacctcgaagtagggggaaaactgcagtggaagatgaggacagcatggatg

SEQ ID NO: 1367 - DNA, 50 bp, Artificial Sequence
  Description of Artificial Sequence: Synthetic oligonucleotide
cctccccattctatacaaaaacaacaaaaacctcgaagtagggggaaaac

SEQ ID NO: 1368 - DNA, 50 bp, Artificial Sequence; identical to SEQ ID NO: 1367
  Description of Artificial Sequence: Synthetic oligonucleotide

SEQ ID NO: 1369 - DNA, 50 bp, Artificial Sequence
  Description of Artificial Sequence: Synthetic oligonucleotide
tctatacaaaaacaacaaaaacctcgaagtagggggaaaactgcagtgga

SEQ ID NO: 1370 - DNA, 100 bp, Artificial Sequence
  Description of Artificial Sequence: Synthetic polynucleotide
acctgcccgttcaccaactctcctccccattctatacaaaaacaacaaaaatgaaaagaaagttggaccatggttctgaggtccgctctttttctttggg

SEQ ID NO: 1371 - DNA, 100 bp, Artificial Sequence
  Description of Artificial Sequence: Synthetic polynucleotide
ggccggcctcgcaaagatggcgcttcccctttccagagagccagaaagaaacctcgaagtagggggaaaactgcagtggaagatgaggacagcatggatg

SEQ ID NO: 1372 - DNA, 50 bp, Artificial Sequence
  Description of Artificial Sequence: Synthetic oligonucleotide
cagagagccagaaagaaacctcgaagtagggggaaaactgcagtggaaga

SEQ ID NO: 1373 - DNA, 49 bp, Artificial Sequence
  Description of Artificial Sequence: Synthetic oligonucleotide
ccagaaagaaacctcgaagtagggggaaaactgcagtggaagatgagga

SEQ ID NO: 1374 - DNA, 100 bp, Artificial Sequence
  Description of Artificial Sequence: Synthetic polynucleotide
acctgcccgttcaccaactctcctccccattctatacaaaaacaacaaaagtgagtatattcaatatattgttaacctgagaaactttacatatctattt

SEQ ID NO: 1375 - DNA, 100 bp, Artificial Sequence
  Description of Artificial Sequence: Synthetic polynucleotide
aaatttaacatttaactctatgtacttattatttttttttttttctgtagacctcgaagtagggggaaaactgcagtggaagatgaggacagcatggatg

SEQ ID NO: 1376 - DNA, 100 bp, Artificial Sequence
  Description of Artificial Sequence: Synthetic polynucleotide
acttggagttggagacaggcacctggataaccttttgctaacaaaaacagccaaaccaaacaggaagcttacttttctctacctagccaatgatgtcata

SEQ ID NO: 1377 - DNA, 50 bp, Artificial Sequence
  Description of Artificial Sequence: Synthetic oligonucleotide
ggcacctggataaccttttgctaacaaaaacagccaaaccaaacaggaag

SEQ ID NO: 1378 - DNA, 50 bp, Artificial Sequence
  Description of Artificial Sequence: Synthetic oligonucleotide
ggataaccttttgctaacaaaaacagccaaaccaaacaggaagcttactt

SEQ ID NO: 1379 - DNA, 100 bp, Artificial Sequence
  Description of Artificial Sequence: Synthetic polynucleotide
acttggagttggagacaggcacctggataaccttttgctaacaaaaacaggcaaactcttccacatagactttggatatattttgggtcgggatccaaag

SEQ ID NO: 1380 - DNA, 50 bp, Artificial Sequence
  Description of Artificial Sequence: Synthetic oligonucleotide
aggcacctggataaccttttgctaacaaaaacaggcaaactcttccacat

SEQ ID NO: 1381 - DNA, 50 bp, Artificial Sequence
  Description of Artificial Sequence: Synthetic oligonucleotide
ggataaccttttgctaacaaaaacaggcaaactcttccacatagactttg

SEQ ID NO: 1382 - DNA, 100 bp, Artificial Sequence
  Description of Artificial Sequence: Synthetic polynucleotide
taaacactcgcgtcccatcgtcaccgtgtgggagcgggagctgcggaaagccaaaccaaacaggaagcttacttttctctacctagccaatgatgtcata

SEQ ID NO: 1383 - DNA, 50 bp, Artificial Sequence
  Description of Artificial Sequence: Synthetic oligonucleotide
ccgtgtgggagcgggagctgcggaaagccaaaccaaacaggaagcttact

SEQ ID NO: 1384 - DNA, 50 bp, Artificial Sequence
  Description of Artificial Sequence: Synthetic oligonucleotide
gtgtgggagcgggagctgcggaaagccaaaccaaacaggaagcttatttt

SEQ ID NO: 1385 - DNA, 50 bp, Artificial Sequence
  Description of Artificial Sequence: Synthetic oligonucleotide
gtgtgggagcgggagctgcggaaagccaaaccaaacaggaagcttacttt

SEQ ID NO: 1386 - DNA, 50 bp, Artificial Sequence; identical to SEQ ID NO: 1384
  Description of Artificial Sequence: Synthetic oligonucleotide

SEQ ID NO: 1387 - DNA, 50 bp, Artificial Sequence; identical to SEQ ID NO: 1385
  Description of Artificial Sequence: Synthetic oligonucleotide

SEQ ID NO: 1388 - DNA, 50 bp, Artificial Sequence
  Description of Artificial Sequence: Synthetic oligonucleotide
gtgtgggagcgggagctgtggaaagccaaaccaaacaggaagcttacttt

SEQ ID NO: 1389 - DNA, 50 bp, Artificial Sequence
  Description of Artificial Sequence: Synthetic oligonucleotide
tgtgggagcgggagctgcggaaagccaaaccaaacaggaagcttactttt

SEQ ID NO: 1390 - DNA, 50 bp, Artificial Sequence
  Description of Artificial Sequence: Synthetic oligonucleotide
gtgggagcgggagctgcggaaagccaaaccaaacaggaagcttacttttc

SEQ ID NO: 1391 - DNA, 49 bp, Artificial Sequence
  Description of Artificial Sequence: Synthetic oligonucleotide
gtgggagcgggagctgcggaaagccaaaccaaacaggaagcttactttt

SEQ ID NO: 1392 - DNA, 50 bp, Artificial Sequence; identical to SEQ ID NO: 1390
  Description of Artificial Sequence: Synthetic oligonucleotide

SEQ ID NO: 1393 - DNA, 49 bp, Artificial Sequence; identical to SEQ ID NO: 1391
  Description of Artificial Sequence: Synthetic oligonucleotide

SEQ ID NO: 1394 - DNA, 50 bp, Artificial Sequence; identical to SEQ ID NO: 1390
  Description of Artificial Sequence: Synthetic oligonucleotide

SEQ ID NO: 1395 - DNA, 50 bp, Artificial Sequence
  Description of Artificial Sequence: Synthetic oligonucleotide
gtgggagcgggagctgcggaaagccaaaccaaataggaagcttacttttc

SEQ ID NO: 1396 - DNA, 50 bp, Artificial Sequence; identical to SEQ ID NO: 1390
  Description of Artificial Sequence: Synthetic oligonucleotide

SEQ ID NO: 1397 - DNA, 49 bp, Artificial Sequence; identical to SEQ ID NO: 1391
  Description of Artificial Sequence: Synthetic oligonucleotide

SEQ ID NO: 1398 - DNA, 50 bp, Artificial Sequence; identical to SEQ ID NO: 1390
  Description of Artificial Sequence: Synthetic oligonucleotide

SEQ ID NO: 1399 - DNA, 50 bp, Artificial Sequence; identical to SEQ ID NO: 1390
  Description of Artificial Sequence: Synthetic oligonucleotide

SEQ ID NO: 1400 - DNA, 49 bp, Artificial Sequence; identical to SEQ ID NO: 1391
  Description of Artificial Sequence: Synthetic oligonucleotide

SEQ ID NO: 1401 - DNA, 50 bp, Artificial Sequence; identical to SEQ ID NO: 1390
  Description of Artificial Sequence: Synthetic oligonucleotide

SEQ ID NO: 1402 - DNA, 50 bp, Artificial Sequence
  Description of Artificial Sequence: Synthetic oligonucleotide
tgggagcgggagctgcggaaagccaaaccaaacaggaagcttacttttct

SEQ ID NO: 1403 - DNA, 50 bp, Artificial Sequence
  Description of Artificial Sequence: Synthetic oligonucleotide
gggagcgggagctgcggaaagccaaaccaaacaggaagcttacttttctc

SEQ ID NO: 1404 - DNA, 50 bp, Artificial Sequence; identical to SEQ ID NO: 1403
  Description of Artificial Sequence: Synthetic oligonucleotide

SEQ ID NO: 1405 - DNA, 50 bp, Artificial Sequence
  Description of Artificial Sequence: Synthetic oligonucleotide
gcgggagctgcggaaagccaaaccaaacaggaagcttacttttttctacc

SEQ ID NO: 1406 - DNA, 50 bp, Artificial Sequence
  Description of Artificial Sequence: Synthetic oligonucleotide
cgggagctgcggaaagccaaaccaaacaggaagcttacttttctctacct

SEQ ID NO: 1407 - DNA, 50 bp, Artificial Sequence; identical to SEQ ID NO: 1406
  Description of Artificial Sequence: Synthetic oligonucleotide

SEQ ID NO: 1408 - DNA, 100 bp, Artificial Sequence
  Description of Artificial Sequence: Synthetic polynucleotide
acttggagttggagacaggcacctggataaccttttgctaacaaaaacaggtaacaattaatgactaccagtagacatacattgtatatgcccatggttt

SEQ ID NO: 1409 - DNA, 50 bp, Artificial Sequence
  Description of Artificial Sequence: Synthetic oligonucleotide
aggcacctggataaccttttgctaacaaaaacaggtaacaattaatgact

SEQ ID NO: 1410 - DNA, 50 bp, Artificial Sequence; identical to SEQ ID NO: 1409
  Description of Artificial Sequence: Synthetic oligonucleotide

SEQ ID NO: 1411 - DNA, 50 bp, Artificial Sequence; identical to SEQ ID NO: 1409
  Description of Artificial Sequence: Synthetic oligonucleotide

SEQ ID NO: 1412 - DNA, 50 bp, Artificial Sequence; identical to SEQ ID NO: 1409
  Description of Artificial Sequence: Synthetic oligonucleotide

SEQ ID NO: 1413 - DNA, 50 bp, Artificial Sequence; identical to SEQ ID NO: 1409
  Description of Artificial Sequence: Synthetic oligonucleotide

SEQ ID NO: 1414 - DNA, 50 bp, Artificial Sequence; identical to SEQ ID NO: 1409
  Description of Artificial Sequence: Synthetic oligonucleotide

SEQ ID NO: 1415 - DNA, 100 bp, Artificial Sequence
  Description of Artificial Sequence: Synthetic polynucleotide
tccaagtaaagatgttttaagtagatttttaactttttcttatttttcagccaaaccaaacaggaagcttacttttctctacctagccaatgatgtcata

SEQ ID NO: 1416 - DNA, 100 bp, Artificial Sequence
  Description of Artificial Sequence: Synthetic polynucleotide
ggagcccaggctgttgctttccagtctggtggtgaatcctccatagtctgctctgtgttctcgttttgcccaagacctttggctagagcagaacataaaa

SEQ ID NO: 1417 - DNA, 50 bp, Artificial Sequence
  Description of Artificial Sequence: Synthetic oligonucleotide
ggtggtgaatcctccatagtctgctctgtgttctcgttttgcccaagacc

SEQ ID NO: 1418 - DNA, 50 bp, Artificial Sequence; identical to SEQ ID NO: 1417
  Description of Artificial Sequence: Synthetic oligonucleotide

SEQ ID NO: 1419 - DNA, 50 bp, Artificial Sequence; identical to SEQ ID NO: 1417
  Description of Artificial Sequence: Synthetic oligonucleotide

SEQ ID NO: 1420 - DNA, 50 bp, Artificial Sequence; identical to SEQ ID NO: 1417
  Description of Artificial Sequence: Synthetic oligonucleotide

SEQ ID NO: 1421 - DNA, 50 bp, Artificial Sequence; identical to SEQ ID NO: 1417
  Description of Artificial Sequence: Synthetic oligonucleotide

SEQ ID NO: 1422 - DNA, 50 bp, Artificial Sequence; identical to SEQ ID NO: 1417
  Description of Artificial Sequence: Synthetic oligonucleotide

SEQ ID NO: 1423 - DNA, 50 bp, Artificial Sequence; identical to SEQ ID NO: 1417
  Description of Artificial Sequence: Synthetic oligonucleotide

SEQ ID NO: 1424 - DNA, 50 bp, Artificial Sequence; identical to SEQ ID NO: 1417
  Description of Artificial Sequence: Synthetic oligonucleotide

SEQ ID NO: 1425 - DNA, 100 bp, Artificial Sequence
  Description of Artificial Sequence: Synthetic polynucleotide
ggagcccaggctgttgctttccagtctggtggtgaatcctccatagtctggaacagccagctgaaaactctcctggccattggaggctggaacttcggga

SEQ ID NO: 1426 - DNA, 100 bp, Artificial Sequence
  Description of Artificial Sequence: Synthetic polynucleotide
tgtatataggcatgtgatgttagagaactacagaaacctggttttcttggctctgtgttctcgttttgcccaagacctttggctagagcagaacataaaa

SEQ ID NO: 1427 - DNA, 100 bp, Artificial Sequence
  Description of Artificial Sequence: Synthetic polynucleotide
ggagcccaggctgttgctttccagtctggtggtgaatcctccatagtctggtgagtgtaaatatatatatatcttttcccttctccctttcccattgcaa

SEQ ID NO: 1428 - DNA, 100 bp, Artificial Sequence
  Description of Artificial Sequence: Synthetic polynucleotide
tcatctgagtctagcaggtggagtaatttgttattttttgtttctttcagctctgtgttctcgttttgcccaagacctttggctagagcagaacataaaa

SEQ ID NO: 1429 - DNA, 47 bp, Artificial Sequence
  Description of Artificial Sequence: Synthetic oligonucleotide
ggtggagtaatttgttattttttgtttctttcagctctgtgttctcg

SEQ ID NO: 1430 - DNA, 100 bp, Artificial Sequence
  Description of Artificial Sequence: Synthetic polynucleotide
aggagcctgccccgccctggggacgaagagctgcagctcctcctgtgcggaatgggttgaatggcttgcatctggcttctaaggaaggccatgtgaaaat

SEQ ID NO: 1431 - DNA, 50 bp, Artificial Sequence
  Description of Artificial Sequence: Synthetic oligonucleotide
ggggacgaagagctgcagctcctcctgtgcggaatgggttgaatggcttg

SEQ ID NO: 1432 - DNA, 50 bp, Artificial Sequence
  Description of Artificial Sequence: Synthetic oligonucleotide
ctgcagctcctcctgtgcggaatgggttgaatggcttgcatctggcttct

SEQ ID NO: 1433 - DNA, 50 bp, Artificial Sequence
  Description of Artificial Sequence: Synthetic oligonucleotide
cctgtgcggaatgggttgaatggcttgcatctggcttctaaggaaggcca

SEQ ID NO: 1434 - DNA, 49 bp, Artificial Sequence
  Description of Artificial Sequence: Synthetic oligonucleotide
cctgtgcggaatgggttgaatggcttgcatctggcttctaaggaaggcc

SEQ ID NO: 1435 - DNA, 50 bp, Artificial Sequence; identical to SEQ ID NO: 1433
  Description of Artificial Sequence: Synthetic oligonucleotide

SEQ ID NO: 1436 - DNA, 50 bp, Artificial Sequence; identical to SEQ ID NO: 1433
  Description of Artificial Sequence: Synthetic oligonucleotide

SEQ ID NO: 1437 - DNA, 50 bp, Artificial Sequence
  Description of Artificial Sequence: Synthetic oligonucleotide
gtgcggaatgggttgaatggcttgcatctggcttctaaggaaggtcatgt

SEQ ID NO: 1438 - DNA, 100 bp, Artificial Sequence
  Description of Artificial Sequence: Synthetic polynucleotide
aggagcctgccccgccctggggacgaagagctgcagctcctcctgtgcggtgcacgatctgattttctggagagatgtgaagaagactgggtttgtcttt

SEQ ID NO: 1439 - DNA, 50 bp, Artificial Sequence
  Description of Artificial Sequence: Synthetic oligonucleotide
ctggggacgaagagctgcagctcctcctgtgcggtgcacgatctgatttt

SEQ ID NO: 1440 - DNA, 50 bp, Artificial Sequence
  Description of Artificial Sequence: Synthetic oligonucleotide
tggggacgaagagctgcagctcctcctgtgcggtgcacgatctgattttc

SEQ ID NO: 1441 - DNA, 49 bp, Artificial Sequence
  Description of Artificial Sequence: Synthetic oligonucleotide
ggggacgaagagctgcagctcctcctgtgcggtgcacgatctgattttc

SEQ ID NO: 1442 - DNA, 50 bp, Artificial Sequence
  Description of Artificial Sequence: Synthetic oligonucleotide
ggggacgaagagttgcagctcctcctgtgcggtgcacgatctgattttct

SEQ ID NO: 1443 - DNA, 49 bp, Artificial Sequence; identical to SEQ ID NO: 1441
  Description of Artificial Sequence: Synthetic oligonucleotide

SEQ ID NO: 1444 - DNA, 49 bp, Artificial Sequence; identical to SEQ ID NO: 1441
  Description of Artificial Sequence: Synthetic oligonucleotide

SEQ ID NO: 1445 - DNA, 50 bp, Artificial Sequence
  Description of Artificial Sequence: Synthetic oligonucleotide
ggggacgaagagctgcagctcctcctgtgcggtgcacgatctgattctct

SEQ ID NO: 1446 - DNA, 49 bp, Artificial Sequence; identical to SEQ ID NO: 1441
  Description of Artificial Sequence: Synthetic oligonucleotide

SEQ ID NO: 1447 - DNA, 100 bp, Artificial Sequence
  Description of Artificial Sequence: Synthetic polynucleotide
aagctttggatcacctgcggaatggggtagatattaacacctgtaaccagaatgggttgaatggcttgcatctggcttctaaggaaggccatgtgaaaat

SEQ ID NO: 1448 - DNA, 100 bp, Artificial Sequence
  Description of Artificial Sequence: Synthetic polynucleotide
aggagcctgccccgccctggggacgaagagctgcagctcctcctgtgcgggtaaggcgcgcggggagcccccgccctgggaaagagggcgagcgggagcc

SEQ ID NO: 1449 - DNA, 100 bp, Artificial Sequence
  Description of Artificial Sequence: Synthetic polynucleotide
aaagcaccatttgactaaccatgcccttcccgcctctctgctctttacagaatgggttgaatggcttgcatctggcttctaaggaaggccatgtgaaaat

SEQ ID NO: 1450 - DNA, 100 bp, Artificial Sequence
  Description of Artificial Sequence: Synthetic polynucleotide
aattgactctcaggaagaccactgaaaaggagcaacagactcaggagaagattttttacccagaaactacagatatctatgatcgaaagaacatgccaag

SEQ ID NO: 1451 - DNA, 50 bp, Artificial Sequence
  Description of Artificial Sequence: Synthetic oligonucleotide
aaggagcaacagactcaggagaagattttttacccagaaactacagatat

SEQ ID NO: 1452 - DNA, 50 bp, Artificial Sequence; identical to SEQ ID NO: 1451
  Description of Artificial Sequence: Synthetic oligonucleotide

SEQ ID NO: 1453 - DNA, 50 bp, Artificial Sequence; identical to SEQ ID NO: 1451
  Description of Artificial Sequence: Synthetic oligonucleotide

SEQ ID NO: 1454 - DNA, 50 bp, Artificial Sequence; identical to SEQ ID NO: 1451
  Description of Artificial Sequence: Synthetic oligonucleotide

SEQ ID NO: 1455 - DNA, 50 bp, Artificial Sequence; identical to SEQ ID NO: 1451
  Description of Artificial Sequence: Synthetic oligonucleotide

SEQ ID NO: 1456 - DNA, 50 bp, Artificial Sequence; identical to SEQ ID NO: 1451
  Description of Artificial Sequence: Synthetic oligonucleotide

SEQ ID NO: 1457 - DNA, 100 bp, Artificial Sequence
  Description of Artificial Sequence: Synthetic polynucleotide
aattgactctcaggaagaccactgaaaaggagcaacagactcaggagaagatcaaagaaaaactcattcaacagcttgaaaaggagtggcagtctaagct

SEQ ID NO: 1458 - DNA, 100 bp, Artificial Sequence
  Description of Artificial Sequence: Synthetic polynucleotide
ataatgtgattcagtggttgaatgccatggatgagattggattgcctaagattttttacccagaaactacagatatctatgatcgaaagaacatgccaag

SEQ ID NO: 1459 - DNA, 100 bp, Artificial Sequence
  Description of Artificial Sequence: Synthetic polynucleotide
aattgactctcaggaagaccactgaaaaggagcaacagactcaggagaaggtacagtacaagtttatgttgtatcgacatcctttcactcttcaagcctc

SEQ ID NO: 1460 - DNA, 100 bp, Artificial Sequence
  Description of Artificial Sequence: Synthetic polynucleotide
atgaacacagtgaatggatatcttactctgtttcttttatttctccctagattttttacccagaaactacagatatctatgatcgaaagaacatgccaag

SEQ ID NO: 1461 - DNA, 100 bp, Artificial Sequence
  Description of Artificial Sequence: Synthetic polynucleotide
tccttcctaaaaaaccttcgcctcatcctaggagaggagcagctagaagggttttcaaattaaagctttcacagcactgcgcttcctctcagaaccttct

SEQ ID NO: 1462 - DNA, 50 bp, Artificial Sequence
  Description of Artificial Sequence: Synthetic oligonucleotide
aggagaggagcagctagaagggttttcaaattaaagctttcacagcactg

SEQ ID NO: 1463 - DNA, 50 bp, Artificial Sequence; identical to SEQ ID NO: 1462
  Description of Artificial Sequence: Synthetic oligonucleotide

SEQ ID NO: 1464 - DNA, 100 bp, Artificial Sequence
  Description of Artificial Sequence: Synthetic polynucleotide
tccttcctaaaaaaccttcgcctcatcctaggagaggagcagctagaagggaattactccttctacgtcctcgacaaccagaacttgcagcaactgtggg

SEQ ID NO: 1465 - DNA, 50 bp, Artificial Sequence
  Description of Artificial Sequence: Synthetic oligonucleotide
tcgcttcatcctaggagaggagcagctagaagggaattactccttctacg

SEQ ID NO: 1466 - DNA, 50 bp, Artificial Sequence
  Description of Artificial Sequence: Synthetic oligonucleotide
tcgcctcatcctaggagaggagcagctagaagggaattactccttctacg

SEQ ID NO: 1467 - DNA, 50 bp, Artificial Sequence
  Description of Artificial Sequence: Synthetic oligonucleotide
cgcctcatcctaggagaggagcagctagaagggaattactccttctacgt

SEQ ID NO: 1468 - DNA, 50 bp, Artificial Sequence; identical to SEQ ID NO: 1467
  Description of Artificial Sequence: Synthetic oligonucleotide

SEQ ID NO: 1469 - DNA, 50 bp, Artificial Sequence
  Description of Artificial Sequence: Synthetic oligonucleotide
gcctcatcctaggagaggagcagctagaagggaattactccttctacgtc

SEQ ID NO: 1470 - DNA, 50 bp, Artificial Sequence; identical to SEQ ID NO: 1469
  Description of Artificial Sequence: Synthetic oligonucleotide

SEQ ID NO: 1471 - DNA, 50 bp, Artificial Sequence
  Description of Artificial Sequence: Synthetic oligonucleotide
catcctaggagaggagcagttagaagggaattactccttctacgtcctcg

SEQ ID NO: 1472 - DNA, 50 bp, Artificial Sequence; identical to SEQ ID NO: 1471
  Description of Artificial Sequence: Synthetic oligonucleotide

SEQ ID NO: 1473 - DNA, 50 bp, Artificial Sequence; identical to SEQ ID NO: 1471
  Description of Artificial Sequence: Synthetic oligonucleotide

SEQ ID NO: 1474 - DNA, 50 bp, Artificial Sequence; identical to SEQ ID NO: 1471
  Description of Artificial Sequence: Synthetic oligonucleotide

SEQ ID NO: 1475 - DNA, 50 bp, Artificial Sequence; identical to SEQ ID NO: 1471
  Description of Artificial Sequence: Synthetic oligonucleotide

SEQ ID NO: 1476 - DNA, 50 bp, Artificial Sequence
  Description of Artificial Sequence: Synthetic oligonucleotide
aggagaggagcagctagaagggaattactccttctacgtcctcgacaacc

SEQ ID NO: 1477 - DNA, 50 bp, Artificial Sequence
  Description of Artificial Sequence: Synthetic oligonucleotide
aggagaggagcagctagaagggaattactccttctacgtcttcgacaacc

SEQ ID NO: 1478 - DNA, 50 bp, Artificial Sequence; identical to SEQ ID NO: 1476
  Description of Artificial Sequence: Synthetic oligonucleotide

SEQ ID NO: 1479 - DNA, 50 bp, Artificial Sequence; identical to SEQ ID NO: 1477
  Description of Artificial Sequence: Synthetic oligonucleotide

SEQ ID NO: 1480 - DNA, 50 bp, Artificial Sequence; identical to SEQ ID NO: 1477
  Description of Artificial Sequence: Synthetic oligonucleotide

SEQ ID NO: 1481 - DNA, 50 bp, Artificial Sequence; identical to SEQ ID NO: 1477
  Description of Artificial Sequence: Synthetic oligonucleotide

SEQ ID NO: 1482 - DNA, 50 bp, Artificial Sequence; identical to SEQ ID NO: 1476
  Description of Artificial Sequence: Synthetic oligonucleotide

SEQ ID NO: 1483 - DNA, 50 bp, Artificial Sequence
  Description of Artificial Sequence: Synthetic oligonucleotide
aggggaggagcagctagaagggaattactccttctacgtcctcgacaacc

SEQ ID NO: 1484 - DNA, 50 bp, Artificial Sequence; identical to SEQ ID NO: 1476
  Description of Artificial Sequence: Synthetic oligonucleotide

SEQ ID NO: 1485 - DNA, 50 bp, Artificial Sequence
  Description of Artificial Sequence: Synthetic oligonucleotide
aggagaggagcagctagaagggaattactctttctacgtcctcgacaacc

SEQ ID NO: 1486 - DNA, 50 bp, Artificial Sequence; identical to SEQ ID NO: 1477
  Description of Artificial Sequence: Synthetic oligonucleotide

SEQ ID NO: 1487 - DNA, 50 bp, Artificial Sequence; identical to SEQ ID NO: 1485
  Description of Artificial Sequence: Synthetic oligonucleotide

SEQ ID NO: 1488 - DNA, 50 bp, Artificial Sequence; identical to SEQ ID NO: 1476
  Description of Artificial Sequence: Synthetic oligonucleotide

SEQ ID NO: 1489 - DNA, 50 bp, Artificial Sequence; identical to SEQ ID NO: 1476
  Description of Artificial Sequence: Synthetic oligonucleotide

SEQ ID NO: 1490 - DNA, 50 bp, Artificial Sequence; identical to SEQ ID NO: 1476
  Description of Artificial Sequence: Synthetic oligonucleotide

SEQ ID NO: 1491 - DNA, 50 bp, Artificial Sequence; identical to SEQ ID NO: 1476
  Description of Artificial Sequence: Synthetic oligonucleotide

SEQ ID NO: 1492 - DNA, 50 bp, Artificial Sequence
  Description of Artificial Sequence: Synthetic oligonucleotide
aggagaggagcagctagaagggaattactccttctacgtcatcgacaacc

SEQ ID NO: 1493 - DNA, 50 bp, Artificial Sequence; identical to SEQ ID NO: 1476
  Description of Artificial Sequence: Synthetic oligonucleotide

SEQ ID NO: 1494 - DNA, 50 bp, Artificial Sequence; identical to SEQ ID NO: 1492
  Description of Artificial Sequence: Synthetic oligonucleotide

SEQ ID NO: 1495 - DNA, 50 bp, Artificial Sequence; identical to SEQ ID NO: 1476
  Description of Artificial Sequence: Synthetic oligonucleotide

SEQ ID NO: 1496 - DNA, 50 bp, Artificial Sequence; identical to SEQ ID NO: 1476
  Description of Artificial Sequence: Synthetic oligonucleotide

SEQ ID NO: 1497 - DNA, 50 bp, Artificial Sequence; identical to SEQ ID NO: 1476
  Description of Artificial Sequence: Synthetic oligonucleotide

SEQ ID NO: 1498 - DNA, 50 bp, Artificial Sequence
  Description of Artificial Sequence: Synthetic oligonucleotide
aggagaggagcagctagaagggaattgctccttctacgtcctcgacaacc

SEQ ID NO: 1499 - DNA, 50 bp, Artificial Sequence; identical to SEQ ID NO: 1476
  Description of Artificial Sequence: Synthetic oligonucleotide

SEQ ID NO: 1500 - DNA, 50 bp, Artificial Sequence; identical to SEQ ID NO: 1492
  Description of Artificial Sequence: Synthetic oligonucleotide

SEQ ID NO: 1501 - DNA, 50 bp, Artificial Sequence
  Description of Artificial Sequence: Synthetic oligonucleotide
gagaggagcagctagaagggaattactccttctacgtcatcgacaaccag

SEQ ID NO: 1502 - DNA, 50 bp, Artificial Sequence; identical to SEQ ID NO: 1501
  Description of Artificial Sequence: Synthetic oligonucleotide

SEQ ID NO: 1503 - DNA, 50 bp, Artificial Sequence; identical to SEQ ID NO: 1501
  Description of Artificial Sequence: Synthetic oligonucleotide

SEQ ID NO: 1504 - DNA, 50 bp, Artificial Sequence; identical to SEQ ID NO: 1501
  Description of Artificial Sequence: Synthetic oligonucleotide

SEQ ID NO: 1505 - DNA, 50 bp, Artificial Sequence
  Description of Artificial Sequence: Synthetic oligonucleotide
gagaggagcagctagaagggaattactccttctacgtcctcgataaccag

SEQ ID NO: 1506 - DNA, 50 bp, Artificial Sequence; identical to SEQ ID NO: 1505
  Description of Artificial Sequence: Synthetic oligonucleotide

SEQ ID NO: 1507 - DNA, 50 bp, Artificial Sequence
  Description of Artificial Sequence: Synthetic oligonucleotide
aggagcagctagaagggaattactccttctacgtcctcgacaaccagaac

SEQ ID NO: 1508 - DNA, 50 bp, Artificial Sequence; identical to SEQ ID NO: 1507
  Description of Artificial Sequence: Synthetic oligonucleotide

SEQ ID NO: 1509 - DNA, 50 bp, Artificial Sequence; identical to SEQ ID NO: 1507
  Description of Artificial Sequence: Synthetic oligonucleotide

SEQ ID NO: 1510 - DNA, 50 bp, Artificial Sequence
  Description of Artificial Sequence: Synthetic oligonucleotide
ggagcagctagaagggaattactcattctacgtcctcgacaaccagaact

SEQ ID NO: 1511 - DNA, 50 bp, Artificial Sequence
  Description of Artificial Sequence: Synthetic oligonucleotide
gagcagctagaagggaattactccttctacgtcctcgacaaccagaactt

SEQ ID NO: 1512 - DNA, 49 bp, Artificial Sequence
  Description of Artificial Sequence: Synthetic oligonucleotide
agcagctagaagggaattactccttctacgtcctcgacaaccagaactt

SEQ ID NO: 1513 - DNA, 50 bp, Artificial Sequence
  Description of Artificial Sequence: Synthetic oligonucleotide
agcagctagaagggaattactccttctacgtcctcgacaaccagaacttg

SEQ ID NO: 1514 - DNA, 49 bp, Artificial Sequence; identical to SEQ ID NO: 1512
  Description of Artificial Sequence: Synthetic oligonucleotide

SEQ ID NO: 1515 - DNA, 49 bp, Artificial Sequence; identical to SEQ ID NO: 1512
  Description of Artificial Sequence: Synthetic oligonucleotide

SEQ ID NO: 1516 - DNA, 50 bp, Artificial Sequence; identical to SEQ ID NO: 1513
  Description of Artificial Sequence: Synthetic oligonucleotide

SEQ ID NO: 1517 - DNA, 50 bp, Artificial Sequence
  Description of Artificial Sequence: Synthetic oligonucleotide
agcagctagaagggaattactccttctacgtcgtcgacaaccagaacttg

SEQ ID NO: 1518 - DNA, 49 bp, Artificial Sequence; identical to SEQ ID NO: 1512
  Description of Artificial Sequence: Synthetic oligonucleotide

SEQ ID NO: 1519 - DNA, 50 bp, Artificial Sequence; identical to SEQ ID NO: 1513
  Description of Artificial Sequence: Synthetic oligonucleotide

SEQ ID NO: 1520 - DNA, 50 bp, Artificial Sequence; identical to SEQ ID NO: 1513
  Description of Artificial Sequence: Synthetic oligonucleotide

SEQ ID NO: 1521 - DNA, 50 bp, Artificial Sequence
  Description of Artificial Sequence: Synthetic oligonucleotide
gcagctagaagggaattacttcttctacgtcctcgacaaccagaacttgc

SEQ ID NO: 1522 - DNA, 50 bp, Artificial Sequence
  Description of Artificial Sequence: Synthetic oligonucleotide
gcagctagaagggaattactccttctacgtcctcgacaaccagaacttgc

SEQ ID NO: 1523 - DNA, 50 bp, Artificial Sequence
  Description of Artificial Sequence: Synthetic oligonucleotide
tagaagggaattactccttctacgtcctcgacaaccagaacttgcagcaa

SEQ ID NO: 1524 - DNA, 50 bp, Artificial Sequence
  Description of Artificial Sequence: Synthetic oligonucleotide
agaagggaattacttcttctacgtcctcgacaaccagaacttgcagcaac

SEQ ID NO: 1525 - DNA, 50 bp, Artificial Sequence; identical to SEQ ID NO: 1524
  Description of Artificial Sequence: Synthetic oligonucleotide

SEQ ID NO: 1526 - DNA, 50 bp, Artificial Sequence
  Description of Artificial Sequence: Synthetic oligonucleotide
agaagggaattactccttttacgtcctcgacaaccagaacttgcagcaac

SEQ ID NO: 1527 - DNA, 100 bp, Artificial Sequence
  Description of Artificial Sequence: Synthetic polynucleotide
ttttgtactcttcggagcttccttgttcagcgcgcatcttcaagtaaccggttttcaaattaaagctttcacagcactgcgcttcctctcagaaccttct

SEQ ID NO: 1528 - DNA, 100 bp, Artificial Sequence
  Description of Artificial Sequence: Synthetic polynucleotide
tccttcctaaaaaaccttcgcctcatcctaggagaggagcagctagaagggtaagtgccccaaatttcatgagctgacgttctattacaaaataagcagc

SEQ ID NO: 1529 - DNA, 50 bp, Artificial Sequence
  Description of Artificial Sequence: Synthetic oligonucleotide
taggagaggagcagctagaagggtaagtgccccaaatttcatgagctgac

SEQ ID NO: 1530 - DNA, 50 bp, Artificial Sequence; identical to SEQ ID NO: 1529
  Description of Artificial Sequence: Synthetic oligonucleotide

SEQ ID NO: 1531 - DNA, 50 bp, Artificial Sequence
  Description of Artificial Sequence: Synthetic oligonucleotide
aggagaggagcagctagaagggtaagtgccccaaatttcatgagctgacg

SEQ ID NO: 1532 - DNA, 50 bp, Artificial Sequence; identical to SEQ ID NO: 1531
  Description of Artificial Sequence: Synthetic oligonucleotide

SEQ ID NO: 1533 - DNA, 50 bp, Artificial Sequence
  Description of Artificial Sequence: Synthetic oligonucleotide
aggagaggagcagctagaagggtaagtgtcccaaatttcatgagctgacg

SEQ ID NO: 1534 - DNA, 50 bp, Artificial Sequence; identical to SEQ ID NO: 1531
  Description of Artificial Sequence: Synthetic oligonucleotide

SEQ ID NO: 1535 - DNA, 50 bp, Artificial Sequence; identical to SEQ ID NO: 1533
  Description of Artificial Sequence: Synthetic oligonucleotide

SEQ ID NO: 1536 - DNA, 50 bp, Artificial Sequence; identical to SEQ ID NO: 1531
  Description of Artificial Sequence: Synthetic oligonucleotide

SEQ ID NO: 1537 - DNA, 50 bp, Artificial Sequence
  Description of Artificial Sequence: Synthetic oligonucleotide
aggagaggagcagttagaagggtaagtgccccaaatttcatgagctgacg

SEQ ID NO: 1538 - DNA, 50 bp, Artificial Sequence; identical to SEQ ID NO: 1531
  Description of Artificial Sequence: Synthetic oligonucleotide

SEQ ID NO: 1539 - DNA, 50 bp, Artificial Sequence; identical to SEQ ID NO: 1531
  Description of Artificial Sequence: Synthetic oligonucleotide

SEQ ID NO: 1540 - DNA, 50 bp, Artificial Sequence; identical to SEQ ID NO: 1531
  Description of Artificial Sequence: Synthetic oligonucleotide

SEQ ID NO: 1541 - DNA, 50 bp, Artificial Sequence; identical to SEQ ID NO: 1531
  Description of Artificial Sequence: Synthetic oligonucleotide

SEQ ID NO: 1542 - DNA, 50 bp, Artificial Sequence; identical to SEQ ID NO: 1533
  Description of Artificial Sequence: Synthetic oligonucleotide

SEQ ID NO: 1543 - DNA, 50 bp, Artificial Sequence; identical to SEQ ID NO: 1531
  Description of Artificial Sequence: Synthetic oligonucleotide

SEQ ID NO: 1544 - DNA, 50 bp, Artificial Sequence; identical to SEQ ID NO: 1533
  Description of Artificial Sequence: Synthetic oligonucleotide

SEQ ID NO: 1545 - DNA, 50 bp, Artificial Sequence; identical to SEQ ID NO: 1531
  Description of Artificial Sequence: Synthetic oligonucleotide

SEQ ID NO: 1546 - DNA, 50 bp, Artificial Sequence; identical to SEQ ID NO: 1531
  Description of Artificial Sequence: Synthetic oligonucleotide

SEQ ID NO: 1547 - DNA, 50 bp, Artificial Sequence; identical to SEQ ID NO: 1531
  Description of Artificial Sequence: Synthetic oligonucleotide

SEQ ID NO: 1548 - DNA, 49 bp, Artificial Sequence
  Description of Artificial Sequence: Synthetic oligonucleotide
ggagaggagcagctagaagggtaagtgccccaaatttcatgagctgacg

SEQ ID NO: 1549 - DNA, 49 bp, Artificial Sequence; identical to SEQ ID NO: 1548
  Description of Artificial Sequence: Synthetic oligonucleotide

SEQ ID NO: 1550 - DNA, 50 bp, Artificial Sequence
  Description of Artificial Sequence: Synthetic oligonucleotide
ggagcagttagaagggtaagtgccccaaatttcatgagctgacgttctat

SEQ ID NO: 1551 - DNA, 50 bp, Artificial Sequence; identical to SEQ ID NO: 1550
  Description of Artificial Sequence: Synthetic oligonucleotide

SEQ ID NO: 1552 - DNA, 50 bp, Artificial Sequence; identical to SEQ ID NO: 1550
  Description of Artificial Sequence: Synthetic oligonucleotide

SEQ ID NO: 1553 - DNA, 49 bp, Artificial Sequence
  Description of Artificial Sequence: Synthetic oligonucleotide
agcagctagaagggtaagtgccccaaatttcatgagctgacgttctatt

SEQ ID NO: 1554 - DNA, 50 bp, Artificial Sequence
  Description of Artificial Sequence: Synthetic oligonucleotide
agcagctagaagggtaagtgccccaaatttcatgagctgacgttctatta

SEQ ID NO: 1555 - DNA, 49 bp, Artificial Sequence; identical to SEQ ID NO: 1553
  Description of Artificial Sequence: Synthetic oligonucleotide

SEQ ID NO: 1556 - DNA, 49 bp, Artificial Sequence; identical to SEQ ID NO: 1553
  Description of Artificial Sequence: Synthetic oligonucleotide

SEQ ID NO: 1557 - DNA, 50 bp, Artificial Sequence
  Description of Artificial Sequence: Synthetic oligonucleotide
gcagctagaagggtaagtgctccaaatttcatgagctgacgttctattac

SEQ ID NO: 1558 - DNA, 50 bp, Artificial Sequence; identical to SEQ ID NO: 1557
  Description of Artificial Sequence: Synthetic oligonucleotide

SEQ ID NO: 1559 - DNA, 50 bp, Artificial Sequence; identical to SEQ ID NO: 1557
  Description of Artificial Sequence: Synthetic oligonucleotide

SEQ ID NO: 1560 - DNA, 50 bp, Artificial Sequence; identical to SEQ ID NO: 1557
  Description of Artificial Sequence: Synthetic oligonucleotide

SEQ ID NO: 1561 - DNA, 50 bp, Artificial Sequence; identical to SEQ ID NO: 1557
  Description of Artificial Sequence: Synthetic oligonucleotide

SEQ ID NO: 1562 - DNA, 49 bp, Artificial Sequence
  Description of Artificial Sequence: Synthetic oligonucleotide
cagctagaagggtaagtgccccaaatttcatgagctgacgttctattac

SEQ ID NO: 1563 - DNA, 49 bp, Artificial Sequence; identical to SEQ ID NO: 1562
  Description of Artificial Sequence: Synthetic oligonucleotide

SEQ ID NO: 1564 - DNA, 50 bp, Artificial Sequence
  Description of Artificial Sequence: Synthetic oligonucleotide
agaagggtaagtgccccaaatttcatgagctgacgttctattacaaaata

SEQ ID NO: 1565 - DNA, 50 bp, Artificial Sequence; identical to SEQ ID NO: 1564
  Description of Artificial Sequence: Synthetic oligonucleotide

SEQ ID NO: 1566 - DNA, 50 bp, Artificial Sequence; identical to SEQ ID NO: 1564
  Description of Artificial Sequence: Synthetic oligonucleotide

SEQ ID NO: 1567 - DNA, 50 bp, Artificial Sequence; identical to SEQ ID NO: 1564
  Description of Artificial Sequence: Synthetic oligonucleotide

SEQ ID NO: 1568 - DNA, 50 bp, Artificial Sequence; identical to SEQ ID NO: 1564
  Description of Artificial Sequence: Synthetic oligonucleotide

SEQ ID NO: 1569 - DNA, 50 bp, Artificial Sequence; identical to SEQ ID NO: 1564
  Description of Artificial Sequence: Synthetic oligonucleotide

SEQ ID NO: 1570 - DNA, 50 bp, Artificial Sequence
  Description of Artificial Sequence: Synthetic oligonucleotide
agaagggtaagtgcctcaaatttcatgagctgacgttctattacaaaata

SEQ ID NO: 1571 - DNA, 50 bp, Artificial Sequence; identical to SEQ ID NO: 1564
  Description of Artificial Sequence: Synthetic oligonucleotide

SEQ ID NO: 1572 - DNA, 50 bp, Artificial Sequence; identical to SEQ ID NO: 1564
  Description of Artificial Sequence: Synthetic oligonucleotide

SEQ ID NO: 1573 - DNA, 50 bp, Artificial Sequence; identical to SEQ ID NO: 1564
  Description of Artificial Sequence: Synthetic oligonucleotide

SEQ ID NO: 1574 - DNA, 100 bp, Artificial Sequence
  Description of Artificial Sequence: Synthetic polynucleotide
gagatttatttgaatacatgaacatatttccctgtgctctcttgttccaggttttcaaattaaagctttcacagcactgcgcttcctctcagaaccttct

SEQ ID NO: 1575 - DNA, 100 bp, Artificial Sequence
  Description of Artificial Sequence: Synthetic polynucleotide
tgcggaggtcaaactggcaatatttgggagagcaggcgtgggcaagtcaggcagctcctttgggacccagatcatcgggggccgggaggtgatcccccac

SEQ ID NO: 1576 - DNA, 50 bp, Artificial Sequence
  Description of Artificial Sequence: Synthetic oligonucleotide
caggcgtgggcaagtcaggcagctcctttgggacccagatcatcgggggc

SEQ ID NO: 1577 - DNA, 100 bp, Artificial Sequence
  Description of Artificial Sequence: Synthetic polynucleotide
tgcggaggtcaaactggcaatatttgggagagcaggcgtgggcaagtcagctcttgtagtgagatttctgaccaaacggttcatctgggaatatgatccc

SEQ ID NO: 1578 - DNA, 50 bp, Artificial Sequence
  Description of Artificial Sequence: Synthetic oligonucleotide
ttgggagagcaggcgtgggcaagtcagctcttgtagtgagatttctgacc

SEQ ID NO: 1579 - DNA, 50 bp, Artificial Sequence; identical to SEQ ID NO: 1578
  Description of Artificial Sequence: Synthetic oligonucleotide

SEQ ID NO: 1580 - DNA, 50 bp, Artificial Sequence
  Description of Artificial Sequence: Synthetic oligonucleotide
gggagagcaggcgtgggcaagtcagctcttgtagtgagatttctgaccaa

SEQ ID NO: 1581 - DNA, 50 bp, Artificial Sequence; identical to SEQ ID NO: 1580
  Description of Artificial Sequence: Synthetic oligonucleotide

SEQ ID NO: 1582 - DNA, 50 bp, Artificial Sequence; identical to SEQ ID NO: 1580
  Description of Artificial Sequence: Synthetic oligonucleotide

SEQ ID NO: 1583 - DNA, 50 bp, Artificial Sequence
  Description of Artificial Sequence: Synthetic oligonucleotide
gggagagcaggcgtgggcaagtcagctcttgtagtgagatttttgaccaa

SEQ ID NO: 1584 - DNA, 50 bp, Artificial Sequence; identical to SEQ ID NO: 1580
  Description of Artificial Sequence: Synthetic oligonucleotide

SEQ ID NO: 1585 - DNA, 50 bp, Artificial Sequence
  Description of Artificial Sequence: Synthetic oligonucleotide
agcaggcgtgggcaagtcagctcttgtagtgagatttctggccaaacggt

SEQ ID NO: 1586 - DNA, 50 bp, Artificial Sequence
  Description of Artificial Sequence: Synthetic oligonucleotide
agcaggcgtgggcaagtcagctcttgtagtgagatttctgaccaaacggt

SEQ ID NO: 1587 - DNA, 50 bp, Artificial Sequence; identical to SEQ ID NO: 1586
  Description of Artificial Sequence: Synthetic oligonucleotide

SEQ ID NO: 1588 - DNA, 50 bp, Artificial Sequence
  Description of Artificial Sequence: Synthetic oligonucleotide
agcaggcgtgggcaagtcagctcttgtagtgagatttctgaccaaatggt

SEQ ID NO: 1589 - DNA, 50 bp, Artificial Sequence
  Description of Artificial Sequence: Synthetic oligonucleotide
gcaggcgtgggcaagtcagctcttgtagtgagatttctgaccaaacggtt

SEQ ID NO: 1590 - DNA, 50 bp, Artificial Sequence; identical to SEQ ID NO: 1589
  Description of Artificial Sequence: Synthetic oligonucleotide

SEQ ID NO: 1591 - DNA, 50 bp, Artificial Sequence
  Description of Artificial Sequence: Synthetic oligonucleotide
caggcgtgggcaagtcagctcttgtagtgagatttctgaccaaacggttc

SEQ ID NO: 1592 - DNA, 50 bp, Artificial Sequence; identical to SEQ ID NO: 1591
  Description of Artificial Sequence: Synthetic oligonucleotide

SEQ ID NO: 1593 - DNA, 50 bp, Artificial Sequence; identical to SEQ ID NO: 1591
  Description of Artificial Sequence: Synthetic oligonucleotide

SEQ ID NO: 1594 - DNA, 50 bp, Artificial Sequence; identical to SEQ ID NO: 1591
  Description of Artificial Sequence: Synthetic oligonucleotide

SEQ ID NO: 1595 - DNA, 50 bp, Artificial Sequence; identical to SEQ ID NO: 1591
  Description of Artificial Sequence: Synthetic oligonucleotide

SEQ ID NO: 1596 - DNA, 50 bp, Artificial Sequence; identical to SEQ ID NO: 1591
  Description of Artificial Sequence: Synthetic oligonucleotide

SEQ ID NO: 1597 - DNA, 50 bp, Artificial Sequence; identical to SEQ ID NO: 1591
  Description of Artificial Sequence: Synthetic oligonucleotide

SEQ ID NO: 1598 - DNA, 50 bp, Artificial Sequence; identical to SEQ ID NO: 1591
  Description of Artificial Sequence: Synthetic oligonucleotide

SEQ ID NO: 1599 - DNA, 50 bp, Artificial Sequence; identical to SEQ ID NO: 1591
  Description of Artificial Sequence: Synthetic oligonucleotide

SEQ ID NO: 1600 - DNA, 50 bp, Artificial Sequence
  Description of Artificial Sequence: Synthetic oligonucleotide
caggcgtgggcgagtcagctcttgtagtgagatttctgaccaaacggttc

SEQ ID NO: 1601 - DNA, 50 bp, Artificial Sequence
  Description of Artificial Sequence: Synthetic oligonucleotide
caggcgtgggcaagtcagctcttgtagtgagatttctgaccaaccggttc

SEQ ID NO: 1602 - DNA, 50 bp, Artificial Sequence; identical to SEQ ID NO: 1591
  Description of Artificial Sequence: Synthetic oligonucleotide

SEQ ID NO: 1603 - DNA, 50 bp, Artificial Sequence; identical to SEQ ID NO: 1591
  Description of Artificial Sequence: Synthetic oligonucleotide

SEQ ID NO: 1604 - DNA, 50 bp, Artificial Sequence
  Description of Artificial Sequence: Synthetic oligonucleotide
aggcgtgggcaagtcagctcttgtagtgagatttctgaccaaacggttca

SEQ ID NO: 1605 - DNA, 50 bp, Artificial Sequence
  Description of Artificial Sequence: Synthetic oligonucleotide
ggcgtgggcaagtcagctcttgtagtgagatttctgaccaaacggttcat

SEQ ID NO: 1606 - DNA, 49 bp, Artificial Sequence
  Description of Artificial Sequence: Synthetic oligonucleotide
ggcgtgggcaagtcagctcttgtagtgagatttctgaccaaacggttca

SEQ ID NO: 1607 - DNA, 49 bp, Artificial Sequence; identical to SEQ ID NO: 1606
  Description of Artificial Sequence: Synthetic oligonucleotide

SEQ ID NO: 1608 - DNA, 50 bp, Artificial Sequence
  Description of Artificial Sequence: Synthetic oligonucleotide
cgtgggcaagtcagctcttgtagtgagatttctgaccaaacggttcatct

SEQ ID NO: 1609 - DNA, 50 bp, Artificial Sequence; identical to SEQ ID NO: 1608
  Description of Artificial Sequence: Synthetic oligonucleotide

SEQ ID NO: 1610 - DNA, 50 bp, Artificial Sequence
  Description of Artificial Sequence: Synthetic oligonucleotide
cgtgggcaagtcagctcttgtagtgagatttctgaccaaacggtttatct

SEQ ID NO: 1611 - DNA, 50 bp, Artificial Sequence; identical to SEQ ID NO: 1608
  Description of Artificial Sequence: Synthetic oligonucleotide

SEQ ID NO: 1612 - DNA, 50 bp, Artificial Sequence; identical to SEQ ID NO: 1608
  Description of Artificial Sequence: Synthetic oligonucleotide

SEQ ID NO: 1613 - DNA, 50 bp, Artificial Sequence; identical to SEQ ID NO: 1608
  Description of Artificial Sequence: Synthetic oligonucleotide

SEQ ID NO: 1614 - DNA, 50 bp, Artificial Sequence; identical to SEQ ID NO: 1608
  Description of Artificial Sequence: Synthetic oligonucleotide

SEQ ID NO: 1615 - DNA, 49 bp, Artificial Sequence
  Description of Artificial Sequence: Synthetic oligonucleotide
gtgggcaagtcagctcttgtagtgagatttctgaccaaacggttcatct

SEQ ID NO: 1616 - DNA, 50 bp, Artificial Sequence
  Description of Artificial Sequence: Synthetic oligonucleotide
gtgggcaagtcagctcttgtagtgagatttctgaccaaacggttcatctg

SEQ ID NO: 1617 - DNA, 50 bp, Artificial Sequence; identical to SEQ ID NO: 1616
  Description of Artificial Sequence: Synthetic oligonucleotide

SEQ ID NO: 1618 - DNA, 50 bp, Artificial Sequence
  Description of Artificial Sequence: Synthetic oligonucleotide
tgggcaagtcagctcttgtagtgagatttctgaccaaacggttcatctgg

SEQ ID NO: 1619 - DNA, 50 bp, Artificial Sequence; identical to SEQ ID NO: 1618
  Description of Artificial Sequence: Synthetic oligonucleotide

SEQ ID NO: 1620 - DNA, 50 bp, Artificial Sequence; identical to SEQ ID NO: 1618
  Description of Artificial Sequence: Synthetic oligonucleotide

SEQ ID NO: 1621 - DNA, 50 bp, Artificial Sequence; identical to SEQ ID NO: 1618
  Description of Artificial Sequence: Synthetic oligonucleotide

SEQ ID NO: 1622 - DNA, 50 bp, Artificial Sequence; identical to SEQ ID NO: 1618
  Description of Artificial Sequence: Synthetic oligonucleotide

SEQ ID NO: 1623 - DNA, 50 bp, Artificial Sequence; identical to SEQ ID NO: 1618
  Description of Artificial Sequence: Synthetic oligonucleotide

SEQ ID NO: 1624 - DNA, 50 bp, Artificial Sequence; identical to SEQ ID NO: 1618
  Description of Artificial Sequence: Synthetic oligonucleotide

SEQ ID NO: 1625 - DNA, 50 bp, Artificial Sequence; identical to SEQ ID NO: 1618
  Description of Artificial Sequence: Synthetic oligonucleotide

SEQ ID NO: 1626 - DNA, 50 bp, Artificial Sequence; identical to SEQ ID NO: 1618
  Description of Artificial Sequence: Synthetic oligonucleotide

SEQ ID NO: 1627 - DNA, 50 bp, Artificial Sequence
  Description of Artificial Sequence: Synthetic oligonucleotide
gggcaagtcagctcttgtagtgagatttctgaccaaacggttcatctggg

SEQ ID NO: 1628 - DNA, 50 bp, Artificial Sequence; identical to SEQ ID NO: 1627
  Description of Artificial Sequence: Synthetic oligonucleotide

SEQ ID NO: 1629 - DNA, 50 bp, Artificial Sequence; identical to SEQ ID NO: 1627
  Description of Artificial Sequence: Synthetic oligonucleotide

SEQ ID NO: 1630 - DNA, 50 bp, Artificial Sequence; identical to SEQ ID NO: 1627
  Description of Artificial Sequence: Synthetic oligonucleotide

SEQ ID NO: 1631 - DNA, 50 bp, Artificial Sequence; identical to SEQ ID NO: 1627
  Description of Artificial Sequence: Synthetic oligonucleotide

SEQ ID NO: 1632 - DNA, 50 bp, Artificial Sequence
  Description of Artificial Sequence: Synthetic oligonucleotide
gggcaagtcagctcttgtagtgagatttctgaccaaacggttcatttggg

SEQ ID NO: 1633 - DNA, 50 bp, Artificial Sequence; identical to SEQ ID NO: 1627
  Description of Artificial Sequence: Synthetic oligonucleotide

SEQ ID NO: 1634 - DNA, 50 bp, Artificial Sequence; identical to SEQ ID NO: 1627
  Description of Artificial Sequence: Synthetic oligonucleotide

SEQ ID NO: 1635 - DNA, 50 bp, Artificial Sequence; identical to SEQ ID NO: 1627
  Description of Artificial Sequence: Synthetic oligonucleotide

SEQ ID NO: 1636 - DNA, 50 bp, Artificial Sequence
  Description of Artificial Sequence: Synthetic oligonucleotide
gggcaagtcagctcttgtagtgagatttctgaccaaacggttcacctggg

SEQ ID NO: 1637 - DNA, 50 bp, Artificial Sequence; identical to SEQ ID NO: 1627
  Description of Artificial Sequence: Synthetic oligonucleotide

SEQ ID NO: 1638 - DNA, 50 bp, Artificial Sequence
  Description of Artificial Sequence: Synthetic oligonucleotide
gggcaagtcagctcttgtagtgagatttctgaccaaacggatcatctggg

SEQ ID NO: 1639 - DNA, 50 bp, Artificial Sequence; identical to SEQ ID NO: 1627
  Description of Artificial Sequence: Synthetic oligonucleotide

SEQ ID NO: 1640 - DNA, 50 bp, Artificial Sequence; identical to SEQ ID NO: 1627
  Description of Artificial Sequence: Synthetic oligonucleotide

SEQ ID NO: 1641 - DNA, 50 bp, Artificial Sequence; identical to SEQ ID NO: 1627
  Description of Artificial Sequence: Synthetic oligonucleotide

SEQ ID NO: 1642 - DNA, 50 bp, Artificial Sequence; identical to SEQ ID NO: 1627
  Description of Artificial Sequence: Synthetic oligonucleotide

SEQ ID NO: 1643 - DNA, 50 bp, Artificial Sequence; identical to SEQ ID NO: 1627
  Description of Artificial Sequence: Synthetic oligonucleotide

SEQ ID NO: 1644 - DNA, 49 bp, Artificial Sequence
  Description of Artificial Sequence: Synthetic oligonucleotide
gggcaagtcagctcttgtagtgagatttctgaccaaacggttcatctgg

SEQ ID NO: 1645 - DNA, 50 bp, Artificial Sequence; identical to SEQ ID NO: 1627
  Description of Artificial Sequence: Synthetic oligonucleotide

SEQ ID NO: 1646 - DNA, 50 bp, Artificial Sequence; identical to SEQ ID NO: 1632
  Description of Artificial Sequence: Synthetic oligonucleotide

SEQ ID NO: 1647 - DNA, 100 bp, Artificial Sequence
  Description of Artificial Sequence: Synthetic polynucleotide
ggcctgcgtgtcttcactgctggtgctggccctgggggccctgtcagtaggcagctcctttgggacccagatcatcgggggccgggaggtgatcccccac

SEQ ID NO: 1648 - DNA, 100 bp, Artificial Sequence
  Description of Artificial Sequence: Synthetic polynucleotide
tgcggaggtcaaactggcaatatttgggagagcaggcgtgggcaagtcaggtaagattttcgttgtggttgttatagtgtgtgtgtgtgggtgagtgtgt

SEQ ID NO: 1649 - DNA, 50 bp, Artificial Sequence
  Description of Artificial Sequence: Synthetic oligonucleotide
tgggagagcaggcgtgggcaagtcaggtaagattttcgttgtggttgtta

SEQ ID NO: 1650 - DNA, 50 bp, Artificial Sequence; identical to SEQ ID NO: 1649
  Description of Artificial Sequence: Synthetic oligonucleotide

SEQ ID NO: 1651 - DNA, 50 bp, Artificial Sequence; identical to SEQ ID NO: 1649
  Description of Artificial Sequence: Synthetic oligonucleotide

SEQ ID NO: 1652 - DNA, 50 bp, Artificial Sequence; identical to SEQ ID NO: 1649
  Description of Artificial Sequence: Synthetic oligonucleotide

SEQ ID NO: 1653 - DNA, 50 bp, Artificial Sequence; identical to SEQ ID NO: 1649
  Description of Artificial Sequence: Synthetic oligonucleotide

SEQ ID NO: 1654 - DNA, 50 bp, Artificial Sequence
  Description of Artificial Sequence: Synthetic oligonucleotide
gggagagcaggcgtgggcaagtcaggtaagattttcgttgtggttgttat

SEQ ID NO: 1655 - DNA, 50 bp, Artificial Sequence; identical to SEQ ID NO: 1654
  Description of Artificial Sequence: Synthetic oligonucleotide

SEQ ID NO: 1656 - DNA, 50 bp, Artificial Sequence; identical to SEQ ID NO: 1654
  Description of Artificial Sequence: Synthetic oligonucleotide

SEQ ID NO: 1657 - DNA, 50 bp, Artificial Sequence; identical to SEQ ID NO: 1654
  Description of Artificial Sequence: Synthetic oligonucleotide

SEQ ID NO: 1658 - DNA, 50 bp, Artificial Sequence
  Description of Artificial Sequence: Synthetic oligonucleotide
gggagagcaggcgtgggcaagtcaggtaagatttttgttgtggttgttat

SEQ ID NO: 1659 - DNA, 49 bp, Artificial Sequence
  Description of Artificial Sequence: Synthetic oligonucleotide
gagcaggcgtgggcaagtcaggtaagattttcgttgtggttgttatagt

SEQ ID NO: 1660 - DNA, 50 bp, Artificial Sequence
  Description of Artificial Sequence: Synthetic oligonucleotide
agcaggcgtgggcaagtcaggtaagattttcgttgtggttgttatagtgt

SEQ ID NO: 1661 - DNA, 50 bp, Artificial Sequence; identical to SEQ ID NO: 1660
  Description of Artificial Sequence: Synthetic oligonucleotide

SEQ ID NO: 1662 - DNA, 50 bp, Artificial Sequence; identical to SEQ ID NO: 1660
  Description of Artificial Sequence: Synthetic oligonucleotide

SEQ ID NO: 1663 - DNA, 50 bp, Artificial Sequence
  Description of Artificial Sequence: Synthetic oligonucleotide
gcaggcgtgggcaagtcaggtaagattttcgttgtggttgttatagtgtg

SEQ ID NO: 1664 - DNA, 48 bp, Artificial Sequence
  Description of Artificial Sequence: Synthetic oligonucleotide
gcaggcgtgggcaagtcaggtaagattttcgttgtggttgttatagtg

SEQ ID NO: 1665 - DNA, 50 bp, Artificial Sequence; identical to SEQ ID NO: 1663
  Description of Artificial Sequence: Synthetic oligonucleotide

SEQ ID NO: 1666 - DNA, 50 bp, Artificial Sequence
  Description of Artificial Sequence: Synthetic oligonucleotide
gcaggcgtgggcaagtcaggtaagatttttgttgtggttgttatagtgtg

SEQ ID NO: 1667 - DNA, 50 bp, Artificial Sequence; identical to SEQ ID NO: 1663
  Description of Artificial Sequence: Synthetic oligonucleotide

SEQ ID NO: 1668 - DNA, 49 bp, Artificial Sequence
  Description of Artificial Sequence: Synthetic oligonucleotide
caggcgtgggcaagtcaggtaagattttcgttgtggttgttatagtgtg

SEQ ID NO: 1669 - DNA, 49 bp, Artificial Sequence; identical to SEQ ID NO: 1668
  Description of Artificial Sequence: Synthetic oligonucleotide

SEQ ID NO: 1670 - DNA, 49 bp, Artificial Sequence; identical to SEQ ID NO: 1668
  Description of Artificial Sequence: Synthetic oligonucleotide

SEQ ID NO: 1671 - DNA, 50 bp, Artificial Sequence
  Description of Artificial Sequence: Synthetic oligonucleotide
caggcgtgggcaagtcaggtaagattttcgttgtggttgttatagtgtgt

SEQ ID NO: 1672 - DNA, 49 bp, Artificial Sequence; identical to SEQ ID NO: 1668
  Description of Artificial Sequence: Synthetic oligonucleotide

SEQ ID NO: 1673 - DNA, 49 bp, Artificial Sequence; identical to SEQ ID NO: 1668
  Description of Artificial Sequence: Synthetic oligonucleotide

SEQ ID NO: 1674 - DNA, 50 bp, Artificial Sequence
  Description of Artificial Sequence: Synthetic oligonucleotide
aggcgtgggcaagtcaggtaagattttcgttgtggttgttatagtgtgtg

SEQ ID NO: 1675 - DNA, 50 bp, Artificial Sequence
  Description of Artificial Sequence: Synthetic oligonucleotide
gcgtgggcaagtcaggtaagattttcgttgtggttgttatagtgtgtgtg

SEQ ID NO: 1676 - DNA, 50 bp, Artificial Sequence; identical to SEQ ID NO: 1675
  Description of Artificial Sequence: Synthetic oligonucleotide

SEQ ID NO: 1677 - DNA, 50 bp, Artificial Sequence
  Description of Artificial Sequence: Synthetic oligonucleotide
cgtgggcaagtcaggtaagattttcgttgtggttgttatagtgtgtgtgt

SEQ ID NO: 1678 - DNA, 50 bp, Artificial Sequence
  Description of Artificial Sequence: Synthetic oligonucleotide
gtgggcaagtcaggtaagattttcgttgtggttgttatagtgggtgtgtg

SEQ ID NO: 1679 - DNA, 50 bp, Artificial Sequence
  Description of Artificial Sequence: Synthetic oligonucleotide
gtgggcaagtcaggtaagattttcgttgtggttgttatagtgtgtgtgtg

SEQ ID NO: 1680 - DNA, 50 bp, Artificial Sequence
  Description of Artificial Sequence: Synthetic oligonucleotide
gggcaagtcaggtaagattttcgttgtggttgttatagtgtgtgtgcgtg

SEQ ID NO: 1681 - DNA, 50 bp, Artificial Sequence
  Description of Artificial Sequence: Synthetic oligonucleotide
gggcaagtcaggtaagattttcgttgtggttgttatagtgtgtgtgtgtg

SEQ ID NO: 1682 - DNA, 50 bp, Artificial Sequence; identical to SEQ ID NO: 1681
  Description of Artificial Sequence: Synthetic oligonucleotide

SEQ ID NO: 1683 - DNA, 50 bp, Artificial Sequence; identical to SEQ ID NO: 1681
  Description of Artificial Sequence: Synthetic oligonucleotide

SEQ ID NO: 1684 - DNA, 50 bp, Artificial Sequence; identical to SEQ ID NO: 1681
  Description of Artificial Sequence: Synthetic oligonucleotide

SEQ ID NO: 1685 - DNA, 50 bp, Artificial Sequence; identical to SEQ ID NO: 1681
  Description of Artificial Sequence: Synthetic oligonucleotide

SEQ ID NO: 1686 - DNA, 50 bp, Artificial Sequence; identical to SEQ ID NO: 1681
  Description of Artificial Sequence: Synthetic oligonucleotide

SEQ ID NO: 1687 - DNA, 50 bp, Artificial Sequence; identical to SEQ ID NO: 1681
  Description of Artificial Sequence: Synthetic oligonucleotide

SEQ ID NO: 1688 - DNA, 50 bp, Artificial Sequence
  Description of Artificial Sequence: Synthetic oligonucleotide
gggcaagtcaggtaagattttcgttgtggtcgttatagtgtgtgtgtgtg

SEQ ID NO: 1689 - DNA, 50 bp, Artificial Sequence; identical to SEQ ID NO: 1681
  Description of Artificial Sequence: Synthetic oligonucleotide

SEQ ID NO: 1690 - DNA, 48 bp, Artificial Sequence
  Description of Artificial Sequence: Synthetic oligonucleotide
gggcaagtcaggtaagattttcgttgtggttgttatagtgtgtgtgtg

SEQ ID NO: 1691 - DNA, 50 bp, Artificial Sequence; identical to SEQ ID NO: 1681
  Description of Artificial Sequence: Synthetic oligonucleotide

SEQ ID NO: 1692 - DNA, 50 bp, Artificial Sequence; identical to SEQ ID NO: 1681
  Description of Artificial Sequence: Synthetic oligonucleotide

SEQ ID NO: 1693 - DNA, 50 bp, Artificial Sequence; identical to SEQ ID NO: 1681
  Description of Artificial Sequence: Synthetic oligonucleotide

SEQ ID NO: 1694 - DNA, 50 bp, Artificial Sequence; identical to SEQ ID NO: 1681
  Description of Artificial Sequence: Synthetic oligonucleotide

SEQ ID NO: 1695 - DNA, 50 bp, Artificial Sequence; identical to SEQ ID NO: 1681
  Description of Artificial Sequence: Synthetic oligonucleotide

SEQ ID NO: 1696 - DNA, 50 bp, Artificial Sequence; identical to SEQ ID NO: 1681
  Description of Artificial Sequence: Synthetic oligonucleotide

SEQ ID NO: 1697 - DNA, 50 bp, Artificial Sequence
  Description of Artificial Sequence: Synthetic oligonucleotide
gggtaagtcaggtaagattttcgttgtggttgttatagtgtgtgtgtgtg

SEQ ID NO: 1698 - DNA, 50 bp, Artificial Sequence; identical to SEQ ID NO: 1681
  Description of Artificial Sequence: Synthetic oligonucleotide

SEQ ID NO: 1699 - DNA, 50 bp, Artificial Sequence; identical to SEQ ID NO: 1681
  Description of Artificial Sequence: Synthetic oligonucleotide

SEQ ID NO: 1700 - DNA, 50 bp, Artificial Sequence; identical to SEQ ID NO: 1681
  Description of Artificial Sequence: Synthetic oligonucleotide

SEQ ID NO: 1701 - DNA, 50 bp, Artificial Sequence; identical to SEQ ID NO: 1681
  Description of Artificial Sequence: Synthetic oligonucleotide

SEQ ID NO: 1702 - DNA, 50 bp, Artificial Sequence; identical to SEQ ID NO: 1681
  Description of Artificial Sequence: Synthetic oligonucleotide

SEQ ID NO: 1703 - DNA, 50 bp, Artificial Sequence; identical to SEQ ID NO: 1681
  Description of Artificial Sequence: Synthetic oligonucleotide

SEQ ID NO: 1704 - DNA, 50 bp, Artificial Sequence
  Description of Artificial Sequence: Synthetic oligonucleotide
ggcaagtcaggtaagattttcgttgtggttgttatagtgtgtgtgtgtgg

SEQ ID NO: 1705 - DNA, 48 bp, Artificial Sequence
  Description of Artificial Sequence: Synthetic oligonucleotide
gcaagtcaggtaagattttcgttgtggttgttatagtgtgtgtgtgtg

SEQ ID NO: 1706 - DNA, 100 bp, Artificial Sequence
  Description of Artificial Sequence: Synthetic polynucleotide
cagcaggggcatgtagccccaacctggctctttgtcccccatcctggcaggcagctcctttgggacccagatcatcgggggccgggaggtgatcccccac

SEQ ID NO: 1707 - DNA, 100 bp, Artificial Sequence
  Description of Artificial Sequence: Synthetic polynucleotide
tcatcgcagtcctggacacgggggtcgacccgggggctccgggcatgcagacttatttaccaagcattggaggaatatcgtaggtaaaaatgcctattgg

SEQ ID NO: 1708 - DNA, 50 bp, Artificial Sequence
  Description of Artificial Sequence: Synthetic oligonucleotide
cgggggtcgacccgggggctccgggcatgcagacttatttaccaaacatt

SEQ ID NO: 1709 - DNA, 50 bp, Artificial Sequence
  Description of Artificial Sequence: Synthetic oligonucleotide
ggggtcgacccgggggctccgggcatgcagacttatttaccaaacattgg

SEQ ID NO: 1710 - DNA, 50 bp, Artificial Sequence; identical to SEQ ID NO: 1709
  Description of Artificial Sequence: Synthetic oligonucleotide

SEQ ID NO: 1711 - DNA, 50 bp, Artificial Sequence; identical to SEQ ID NO: 1709
  Description of Artificial Sequence: Synthetic oligonucleotide

SEQ ID NO: 1712 - DNA, 100 bp, Artificial Sequence
  Description of Artificial Sequence: Synthetic polynucleotide
tcatcgcagtcctggacacgggggtcgacccgggggctccgggcatgcaggttacaactgatggaaaaccaaaaatcgttgatatcattgatacaacagg

SEQ ID NO: 1713 - DNA, 50 bp, Artificial Sequence
  Description of Artificial Sequence: Synthetic oligonucleotide
acgggggtcgacccgggggctccgggcatgcaggttacaactgatggaaa

SEQ ID NO: 1714 - DNA, 50 bp, Artificial Sequence; identical to SEQ ID NO: 1713
  Description of Artificial Sequence: Synthetic oligonucleotide

SEQ ID NO: 1715 - DNA, 50 bp, Artificial Sequence
  Description of Artificial Sequence: Synthetic oligonucleotide
cgggggtcgacccgggggctccgggcatgcaggttacaactgatggaaaa

SEQ ID NO: 1716 - DNA, 50 bp, Artificial Sequence; identical to SEQ ID NO: 1715
  Description of Artificial Sequence: Synthetic oligonucleotide

SEQ ID NO: 1717 - DNA, 50 bp, Artificial Sequence
  Description of Artificial Sequence: Synthetic oligonucleotide
gggggtcgacccgggggctccgggcatgcaggttacaactgatggaaaac

SEQ ID NO: 1718 - DNA, 49 bp, Artificial Sequence
  Description of Artificial Sequence: Synthetic oligonucleotide
gggggtcgacccgggggctccgggcatgcaggttacaactgatggaaaa

SEQ ID NO: 1719 - DNA, 48 bp, Artificial Sequence
  Description of Artificial Sequence: Synthetic oligonucleotide
gggggtcgacccgggggctccgggcatgcaggttacaactgatggaaa

SEQ ID NO: 1720 - DNA, 50 bp, Artificial Sequence; identical to SEQ ID NO: 1717
  Description of Artificial Sequence: Synthetic oligonucleotide

SEQ ID NO: 1721 - DNA, 50 bp, Artificial Sequence; identical to SEQ ID NO: 1717
  Description of Artificial Sequence: Synthetic oligonucleotide

SEQ ID NO: 1722 - DNA, 49 bp, Artificial Sequence; identical to SEQ ID NO: 1718
  Description of Artificial Sequence: Synthetic oligonucleotide

SEQ ID NO: 1723 - DNA, 50 bp, Artificial Sequence; identical to SEQ ID NO: 1717
  Description of Artificial Sequence: Synthetic oligonucleotide

SEQ ID NO: 1724 - DNA, 49 bp, Artificial Sequence; identical to SEQ ID NO: 1718
  Description of Artificial Sequence: Synthetic oligonucleotide

SEQ ID NO: 1725 - DNA, 48 bp, Artificial Sequence; identical to SEQ ID NO: 1719
  Description of Artificial Sequence: Synthetic oligonucleotide

SEQ ID NO: 1726 - DNA, 50 bp, Artificial Sequence; identical to SEQ ID NO: 1717
  Description of Artificial Sequence: Synthetic oligonucleotide

SEQ ID NO: 1727 - DNA, 49 bp, Artificial Sequence; identical to SEQ ID NO: 1718
  Description of Artificial Sequence: Synthetic oligonucleotide

SEQ ID NO: 1728 - DNA, 50 bp, Artificial Sequence; identical to SEQ ID NO: 1717
  Description of Artificial Sequence: Synthetic oligonucleotide

SEQ ID NO: 1729 - DNA, 48 bp, Artificial Sequence; identical to SEQ ID NO: 1719
  Description of Artificial Sequence: Synthetic oligonucleotide

SEQ ID NO: 1730 - DNA, 49 bp, Artificial Sequence
  Description of Artificial Sequence: Synthetic oligonucleotide
gggggctccgggcatgcaggttacaactgatggaaaaccaaaaatcgtt

SEQ ID NO: 1731 - DNA, 50 bp, Artificial Sequence
  Description of Artificial Sequence: Synthetic oligonucleotide
gggggctccgggcatgcaggttacaactgatggaaaaccaaaaatcgttg

SEQ ID NO: 1732 - DNA, 49 bp, Artificial Sequence; identical to SEQ ID NO: 1730
  Description of Artificial Sequence: Synthetic oligonucleotide

SEQ ID NO: 1733 - DNA, 50 bp, Artificial Sequence; identical to SEQ ID NO: 1731
  Description of Artificial Sequence: Synthetic oligonucleotide

SEQ ID NO: 1734 - DNA, 50 bp, Artificial Sequence; identical to SEQ ID NO: 1731
  Description of Artificial Sequence: Synthetic oligonucleotide

SEQ ID NO: 1735 - DNA, 49 bp, Artificial Sequence; identical to SEQ ID NO: 1730
  Description of Artificial Sequence: Synthetic oligonucleotide

SEQ ID NO: 1736 - DNA, 50 bp, Artificial Sequence
  Description of Artificial Sequence: Synthetic oligonucleotide
ggggctccgggcatgcaggttacaactgatggaaaaccaaaaatcgttga

SEQ ID NO: 1737 - DNA, 50 bp, Artificial Sequence
  Description of Artificial Sequence: Synthetic oligonucleotide
gggactccgggcatgcaggttacaactgatggaaaaccaaaaatcgttga

SEQ ID NO: 1738 - DNA, 50 bp, Artificial Sequence; identical to SEQ ID NO: 1736
  Description of Artificial Sequence: Synthetic oligonucleotide

SEQ ID NO: 1739 - DNA, 50 bp, Artificial Sequence; identical to SEQ ID NO: 1736
  Description of Artificial Sequence: Synthetic oligonucleotide

SEQ ID NO: 1740 - DNA, 50 bp, Artificial Sequence
  Description of Artificial Sequence: Synthetic oligonucleotide
ccgggcatgcaggttacaactgatggaaaaccaaaaatcgttgatatcat

SEQ ID NO: 1741 - DNA, 50 bp, Artificial Sequence; identical to SEQ ID NO: 1740
  Description of Artificial Sequence: Synthetic oligonucleotide

SEQ ID NO: 1742 - DNA, 50 bp, Artificial Sequence; identical to SEQ ID NO: 1740
  Description of Artificial Sequence: Synthetic oligonucleotide

SEQ ID NO: 1743 - DNA, 50 bp, Artificial Sequence; identical to SEQ ID NO: 1740
  Description of Artificial Sequence: Synthetic oligonucleotide

SEQ ID NO: 1744 - DNA, 50 bp, Artificial Sequence; identical to SEQ ID NO: 1740
  Description of Artificial Sequence: Synthetic oligonucleotide

SEQ ID NO: 1745 - DNA, 49 bp, Artificial Sequence
  Description of Artificial Sequence: Synthetic oligonucleotide
cgggcatgcaggttacaactgatggaaaaccaaaaatcgttgatatcat

SEQ ID NO: 1746 - DNA, 49 bp, Artificial Sequence; identical to SEQ ID NO: 1745
  Description of Artificial Sequence: Synthetic oligonucleotide

SEQ ID NO: 1747 - DNA, 49 bp, Artificial Sequence; identical to SEQ ID NO: 1745
  Description of Artificial Sequence: Synthetic oligonucleotide

SEQ ID NO: 1748 - DNA, 50 bp, Artificial Sequence
  Description of Artificial Sequence: Synthetic oligonucleotide
ggcatgcaggttacaactgatggaaaaccaaaaatcgttgatatcattga

SEQ ID NO: 1749 - DNA, 50 bp, Artificial Sequence; identical to SEQ ID NO: 1748
  Description of Artificial Sequence: Synthetic oligonucleotide

SEQ ID NO: 1750 - DNA, 50 bp, Artificial Sequence; identical to SEQ ID NO: 1748
  Description of Artificial Sequence: Synthetic oligonucleotide

SEQ ID NO: 1751 - DNA, 50 bp, Artificial Sequence; identical to SEQ ID NO: 1748
  Description of Artificial Sequence: Synthetic oligonucleotide

SEQ ID NO: 1752 - DNA, 50 bp, Artificial Sequence; identical to SEQ ID NO: 1748
  Description of Artificial Sequence: Synthetic oligonucleotide

SEQ ID NO: 1753 - DNA, 50 bp, Artificial Sequence
  Description of Artificial Sequence: Synthetic oligonucleotide
catgcaggttacaactgatggaaaaccaaaaatcgttgatatcattgata

SEQ ID NO: 1754 - DNA, 50 bp, Artificial Sequence; identical to SEQ ID NO: 1753
  Description of Artificial Sequence: Synthetic oligonucleotide

SEQ ID NO: 1755 - DNA, 50 bp, Artificial Sequence; identical to SEQ ID NO: 1753
  Description of Artificial Sequence: Synthetic oligonucleotide

SEQ ID NO: 1756 - DNA, 50 bp, Artificial Sequence; identical to SEQ ID NO: 1753
  Description of Artificial Sequence: Synthetic oligonucleotide

SEQ ID NO: 1757 - DNA, 50 bp, Artificial Sequence; identical to SEQ ID NO: 1753
  Description of Artificial Sequence: Synthetic oligonucleotide

SEQ ID NO: 1758 - DNA, 49 bp, Artificial Sequence
  Description of Artificial Sequence: Synthetic oligonucleotide
tgcaggttacaactgatggaaaaccaaaaatcgttgatatcattgatac

SEQ ID NO: 1759 - DNA, 100 bp, Artificial Sequence
  Description of Artificial Sequence: Synthetic polynucleotide
ggtttttgtcagcttactccggccaaaaaagaactgcacctctggagcggacttatttaccaagcattggaggaatatcgtaggtaaaaatgcctattgg

SEQ ID NO: 1760 - DNA, 100 bp, Artificial Sequence
  Description of Artificial Sequence: Synthetic polynucleotide
tcatcgcagtcctggacacgggggtcgacccgggggctccgggcatgcaggtgaggcggcccccgagggcccgggcgcgggggcgcgggcggccggggac

SEQ ID NO: 1761 - DNA, 100 bp, Artificial Sequence
  Description of Artificial Sequence: Synthetic polynucleotide
aataaggaatgcatccctgtgtaagtgcattttggtcttctgttttgcagacttatttaccaagcattggaggaatatcgtaggtaaaaatgcctattgg

SEQ ID NO: 1762 - DNA, 100 bp, Artificial Sequence
  Description of Artificial Sequence: Synthetic polynucleotide
gagcagctgccccgctacctcatgggggagacgcagctgtgcaccacaaggttttcttctgttttcatagccagccagaacaatgttctacgcacatttt

SEQ ID NO: 1763 - DNA, 50 bp, Artificial Sequence
  Description of Artificial Sequence: Synthetic oligonucleotide
gggggagacgcagctgtgcaccacaaggttttcttctgttttcatagcca

SEQ ID NO: 1764 - DNA, 50 bp, Artificial Sequence; identical to SEQ ID NO: 1763
  Description of Artificial Sequence: Synthetic oligonucleotide

SEQ ID NO: 1765 - DNA, 100 bp, Artificial Sequence
  Description of Artificial Sequence: Synthetic polynucleotide
gagcagctgccccgctacctcatgggggagacgcagctgtgcaccacaagatgtgtgttaaaagagctagaaacattgggaaaggacttatatggggcaa

SEQ ID NO: 1766 - DNA, 50 bp, Artificial Sequence
  Description of Artificial Sequence: Synthetic oligonucleotide
catgggggagacgcagctgtgcaacacaagatgtgtgttaaaagagctag

SEQ ID NO: 1767 - DNA, 49 bp, Artificial Sequence
  Description of Artificial Sequence: Synthetic oligonucleotide
tgggggagacgcagctgtgcaccacaagatgtgtgttaaaagagctaga

SEQ ID NO: 1768 - DNA, 50 bp, Artificial Sequence
  Description of Artificial Sequence: Synthetic oligonucleotide
tgggggagacgcagctgtgcaccacaagatgtgtgttaaaagagctagaa

SEQ ID NO: 1769 - DNA, 50 bp, Artificial Sequence; identical to SEQ ID NO: 1768
  Description of Artificial Sequence: Synthetic oligonucleotide

SEQ ID NO: 1770 - DNA, 50 bp, Artificial Sequence; identical to SEQ ID NO: 1768
  Description of Artificial Sequence: Synthetic oligonucleotide

SEQ ID NO: 1771 - DNA, 49 bp, Artificial Sequence
  Description of Artificial Sequence: Synthetic oligonucleotide
gggggagacgcagctgtgcaccacaagatgtgtgttaaaagagctagaa

SEQ ID NO: 1772 - DNA, 100 bp, Artificial Sequence
  Description of Artificial Sequence: Synthetic polynucleotide
tttcccctccccgggccacccagcccgcccaactcccagcggagagcaaggttttcttctgttttcatagccagccagaacaatgttctacgcacatttt

SEQ ID NO: 1773 - DNA, 100 bp, Artificial Sequence
  Description of Artificial Sequence: Synthetic polynucleotide
gagcagctgccccgctacctcatgggggagacgcagctgtgcaccacaaggtgggcccggggggctggggaggaggcacagagggtccgtcgggtgttgt

SEQ ID NO: 1774 - DNA, 100 bp, Artificial Sequence
  Description of Artificial Sequence: Synthetic polynucleotide
tatttaaattgtcagatgatgtttacattaacttttttttcccctcttaggttttcttctgttttcatagccagccagaacaatgttctacgcacatttt

SEQ ID NO: 1775 - DNA, 100 bp, Artificial Sequence
  Description of Artificial Sequence: Synthetic polynucleotide
gtgtaagggctcccgctgctggggagagagttctgaggattgtcagagccatgattcaatgaaagtgaaagatgaatacagtgaaagagatgagaatgtt

SEQ ID NO: 1776 - DNA, 50 bp, Artificial Sequence
  Description of Artificial Sequence: Synthetic oligonucleotide
ggggagagagttctgaggattgtcagagccatgattcaatgaaagtgaaa

SEQ ID NO: 1777 - DNA, 50 bp, Artificial Sequence; identical to SEQ ID NO: 1776
  Description of Artificial Sequence: Synthetic oligonucleotide

SEQ ID NO: 1778 - DNA, 50 bp, Artificial Sequence; identical to SEQ ID NO: 1776
  Description of Artificial Sequence: Synthetic oligonucleotide

SEQ ID NO: 1779 - DNA, 50 bp, Artificial Sequence
  Description of Artificial Sequence: Synthetic oligonucleotide
gggtagagagttctgaggattgtcagagccatgattcaatgaaagtgaaa

SEQ ID NO: 1780 - DNA, 100 bp, Artificial Sequence
  Description of Artificial Sequence: Synthetic polynucleotide
gtgtaagggctcccgctgctggggagagagttctgaggattgtcagagcctgacgcgcactgtctgtgccggtggctgtgcccgctgcaaggggccactg

SEQ ID NO: 1781 - DNA, 50 bp, Artificial Sequence
  Description of Artificial Sequence: Synthetic oligonucleotide
gctggggagagagttctgaggattgtcagagcctgacgcgcactgtctgt

SEQ ID NO: 1782 - DNA, 50 bp, Artificial Sequence; identical to SEQ ID NO: 1781
  Description of Artificial Sequence: Synthetic oligonucleotide

SEQ ID NO: 1783 - DNA, 50 bp, Artificial Sequence
  Description of Artificial Sequence: Synthetic oligonucleotide
gctggggagagagttctgaggattgttagagcctgacgcgcactgtctgt

SEQ ID NO: 1784 - DNA, 50 bp, Artificial Sequence; identical to SEQ ID NO: 1781
  Description of Artificial Sequence: Synthetic oligonucleotide

SEQ ID NO: 1785 - DNA, 50 bp, Artificial Sequence; identical to SEQ ID NO: 1781
  Description of Artificial Sequence: Synthetic oligonucleotide

SEQ ID NO: 1786 - DNA, 50 bp, Artificial Sequence; identical to SEQ ID NO: 1781
  Description of Artificial Sequence: Synthetic oligonucleotide

SEQ ID NO: 1787 - DNA, 50 bp, Artificial Sequence; identical to SEQ ID NO: 1781
  Description of Artificial Sequence: Synthetic oligonucleotide

SEQ ID NO: 1788 - DNA, 50 bp, Artificial Sequence; identical to SEQ ID NO: 1781
  Description of Artificial Sequence: Synthetic oligonucleotide

SEQ ID NO: 1789 - DNA, 49 bp, Artificial Sequence
  Description of Artificial Sequence: Synthetic oligonucleotide
gctggggagagagttctgaggattgtcagagcctgacgcgcactgtctg

SEQ ID NO: 1790 - DNA, 50 bp, Artificial Sequence; identical to SEQ ID NO: 1781
  Description of Artificial Sequence: Synthetic oligonucleotide

SEQ ID NO: 1791 - DNA, 50 bp, Artificial Sequence; identical to SEQ ID NO: 1783
  Description of Artificial Sequence: Synthetic oligonucleotide

SEQ ID NO: 1792 - DNA, 50 bp, Artificial Sequence; identical to SEQ ID NO: 1781
  Description of Artificial Sequence: Synthetic oligonucleotide

SEQ ID NO: 1793 - DNA, 50 bp, Artificial Sequence; identical to SEQ ID NO: 1783
  Description of Artificial Sequence: Synthetic oligonucleotide

SEQ ID NO: 1794 - DNA, 50 bp, Artificial Sequence; identical to SEQ ID NO: 1783
  Description of Artificial Sequence: Synthetic oligonucleotide

SEQ ID NO: 1795 - DNA, 50 bp, Artificial Sequence; identical to SEQ ID NO: 1781
  Description of Artificial Sequence: Synthetic oligonucleotide

SEQ ID NO: 1796 - DNA, 50 bp, Artificial Sequence; identical to SEQ ID NO: 1781
  Description of Artificial Sequence: Synthetic oligonucleotide

SEQ ID NO: 1797 - DNA, 50 bp, Artificial Sequence; identical to SEQ ID NO: 1783
  Description of Artificial Sequence: Synthetic oligonucleotide

SEQ ID NO: 1798 - DNA, 50 bp, Artificial Sequence; identical to SEQ ID NO: 1783
  Description of Artificial Sequence: Synthetic oligonucleotide

SEQ ID NO: 1799 - DNA, 50 bp, Artificial Sequence; identical to SEQ ID NO: 1781
  Description of Artificial Sequence: Synthetic oligonucleotide

SEQ ID NO: 1800 - DNA, 50 bp, Artificial Sequence; identical to SEQ ID NO: 1781
  Description of Artificial Sequence: Synthetic oligonucleotide

SEQ ID NO: 1801 - DNA, 50 bp, Artificial Sequence; identical to SEQ ID NO: 1781
  Description of Artificial Sequence: Synthetic oligonucleotide

SEQ ID NO: 1802 - DNA, 50 bp, Artificial Sequence; identical to SEQ ID NO: 1781
  Description of Artificial Sequence: Synthetic oligonucleotide

SEQ ID NO: 1803 - DNA, 50 bp, Artificial Sequence; identical to SEQ ID NO: 1781
  Description of Artificial Sequence: Synthetic oligonucleotide

SEQ ID NO: 1804 - DNA, 50 bp, Artificial Sequence
  Description of Artificial Sequence: Synthetic oligonucleotide
ggggagagagttctgaggattgtcagagcctgacgcgcactgtctgtgcc

SEQ ID NO: 1805 - DNA, 50 bp, Artificial Sequence; identical to SEQ ID NO: 1804
  Description of Artificial Sequence: Synthetic oligonucleotide

SEQ ID NO: 1806 - DNA, 50 bp, Artificial Sequence; identical to SEQ ID NO: 1804
  Description of Artificial Sequence: Synthetic oligonucleotide

SEQ ID NO: 1807 - DNA, 50 bp, Artificial Sequence; identical to SEQ ID NO: 1804
  Description of Artificial Sequence: Synthetic oligonucleotide

SEQ ID NO: 1808 - DNA, 50 bp, Artificial Sequence
  Description of Artificial Sequence: Synthetic oligonucleotide
ggggagagagttctgaggattgttagagcctgacgcgcactgtctgtgcc

SEQ ID NO: 1809 - DNA, 50 bp, Artificial Sequence
  Description of Artificial Sequence: Synthetic oligonucleotide
ggggagagtgttctgaggattgtcagagcctgacgcgcactgtctgtgcc

SEQ ID NO: 1810 - DNA, 50 bp, Artificial Sequence; identical to SEQ ID NO: 1804
  Description of Artificial Sequence: Synthetic oligonucleotide

SEQ ID NO: 1811 - DNA, 50 bp, Artificial Sequence; identical to SEQ ID NO: 1804
  Description of Artificial Sequence: Synthetic oligonucleotide

SEQ ID NO: 1812 - DNA, 50 bp, Artificial Sequence; identical to SEQ ID NO: 1808
  Description of Artificial Sequence: Synthetic oligonucleotide

SEQ ID NO: 1813 - DNA, 50 bp, Artificial Sequence; identical to SEQ ID NO: 1804
  Description of Artificial Sequence: Synthetic oligonucleotide

SEQ ID NO: 1814 - DNA, 50 bp, Artificial Sequence; identical to SEQ ID NO: 1804
  Description of Artificial Sequence: Synthetic oligonucleotide

SEQ ID NO: 1815 - DNA, 100 bp, Artificial Sequence
  Description of Artificial Sequence: Synthetic polynucleotide
aaatgtggacagtggagaaggcccagccaatgaagatgaagacataggagatgattcaatgaaagtgaaagatgaatacagtgaaagagatgagaatgtt

SEQ ID NO: 1816 - DNA, 100 bp, Artificial Sequence
  Description of Artificial Sequence: Synthetic polynucleotide
gtgtaagggctcccgctgctggggagagagttctgaggattgtcagagccgtgagtctcagggaggcctggagtcagggaaggggagggctggggccggg

SEQ ID NO: 1817 - DNA, 50 bp, Artificial Sequence
  Description of Artificial Sequence: Synthetic oligonucleotide
tgctggggagagagttctgaggattgtcagagccgtgagtctcagggagg

SEQ ID NO: 1818 - DNA, 50 bp, Artificial Sequence; identical to SEQ ID NO: 1817
  Description of Artificial Sequence: Synthetic oligonucleotide

SEQ ID NO: 1819 - DNA, 50 bp, Artificial Sequence
  Description of Artificial Sequence: Synthetic oligonucleotide
tgctggggagagagttctgacgattgtcagagccgtgagtctcagggagg

SEQ ID NO: 1820 - DNA, 50 bp, Artificial Sequence; identical to SEQ ID NO: 1817
  Description of Artificial Sequence: Synthetic oligonucleotide

SEQ ID NO: 1821 - DNA, 50 bp, Artificial Sequence; identical to SEQ ID NO: 1817
  Description of Artificial Sequence: Synthetic oligonucleotide

SEQ ID NO: 1822 - DNA, 50 bp, Artificial Sequence
  Description of Artificial Sequence: Synthetic oligonucleotide
gctggggagagagttctgaggattgtcagagccgtgagtctcagggaggc

SEQ ID NO: 1823 - DNA, 50 bp, Artificial Sequence; identical to SEQ ID NO: 1822
  Description of Artificial Sequence: Synthetic oligonucleotide

SEQ ID NO: 1824 - DNA, 50 bp, Artificial Sequence; identical to SEQ ID NO: 1822
  Description of Artificial Sequence: Synthetic oligonucleotide

SEQ ID NO: 1825 - DNA, 50 bp, Artificial Sequence; identical to SEQ ID NO: 1822
  Description of Artificial Sequence: Synthetic oligonucleotide

SEQ ID NO: 1826 - DNA, 50 bp, Artificial Sequence; identical to SEQ ID NO: 1822
  Description of Artificial Sequence: Synthetic oligonucleotide

SEQ ID NO: 1827 - DNA, 50 bp, Artificial Sequence; identical to SEQ ID NO: 1822
  Description of Artificial Sequence: Synthetic oligonucleotide

SEQ ID NO: 1828 - DNA, 50 bp, Artificial Sequence
  Description of Artificial Sequence: Synthetic oligonucleotide
tggggagagagttctgaggattgtcagagccgtgagtctcagggaggcct

SEQ ID NO: 1829 - DNA, 50 bp, Artificial Sequence; identical to SEQ ID NO: 1828
  Description of Artificial Sequence: Synthetic oligonucleotide

SEQ ID NO: 1830 - DNA, 50 bp, Artificial Sequence
  Description of Artificial Sequence: Synthetic oligonucleotide
ggggagagagttctgaggattgtcagagccgtgagtcccagggaggcctg

SEQ ID NO: 1831 - DNA, 48 bp, Artificial Sequence
  Description of Artificial Sequence: Synthetic oligonucleotide
ggggagagagttctgaggattgtcagagccgtgagtctcagggaggcc

SEQ ID NO: 1832 - DNA, 50 bp, Artificial Sequence
  Description of Artificial Sequence: Synthetic oligonucleotide
ggggagagagttctgaggattgtcagagccgtgagtctcagggaggcctg

SEQ ID NO: 1833 - DNA, 50 bp, Artificial Sequence; identical to SEQ ID NO: 1832
  Description of Artificial Sequence: Synthetic oligonucleotide

SEQ ID NO: 1834 - DNA, 50 bp, Artificial Sequence; identical to SEQ ID NO: 1832
  Description of Artificial Sequence: Synthetic oligonucleotide

SEQ ID NO: 1835 - DNA, 50 bp, Artificial Sequence; identical to SEQ ID NO: 1832
  Description of Artificial Sequence: Synthetic oligonucleotide

SEQ ID NO: 1836 - DNA, 48 bp, Artificial Sequence; identical to SEQ ID NO: 1831
  Description of Artificial Sequence: Synthetic oligonucleotide

SEQ ID NO: 1837 - DNA, 50 bp, Artificial Sequence; identical to SEQ ID NO: 1832
  Description of Artificial Sequence: Synthetic oligonucleotide

SEQ ID NO: 1838 - DNA, 50 bp, Artificial Sequence; identical to SEQ ID NO: 1832
  Description of Artificial Sequence: Synthetic oligonucleotide

SEQ ID NO: 1839 - DNA, 50 bp, Artificial Sequence; identical to SEQ ID NO: 1832
  Description of Artificial Sequence: Synthetic oligonucleotide

SEQ ID NO: 1840 - DNA, 50 bp, Artificial Sequence; identical to SEQ ID NO: 1832
  Description of Artificial Sequence: Synthetic oligonucleotide

SEQ ID NO: 1841 - DNA, 50 bp, Artificial Sequence
  Description of Artificial Sequence: Synthetic oligonucleotide
ggggagagagttctgaggattgttagagccgtgagtctcagggaggcctg

SEQ ID NO: 1842 - DNA, 100 bp, Artificial Sequence
  Description of Artificial Sequence: Synthetic polynucleotide
atagcttcaagtatagtcgttgttcatttcttgcattttcttccctgcagatgattcaatgaaagtgaaagatgaatacagtgaaagagatgagaatgtt

SEQ ID NO: 1843 - DNA, 50 bp, Artificial Sequence
  Description of Artificial Sequence: Synthetic oligonucleotide
tcttccctgcagatgatttaatgaaagtgaaagatgaatacagtgaaaga

SEQ ID NO: 1844 - DNA, 50 bp, Artificial Sequence; identical to SEQ ID NO: 1843
  Description of Artificial Sequence: Synthetic oligonucleotide

SEQ ID NO: 1845 - DNA, 100 bp, Artificial Sequence
  Description of Artificial Sequence: Synthetic polynucleotide
agaggatggaacacagcggtgtgagaagtgcagcaagccctgtgcccgagatgattcaatgaaagtgaaagatgaatacagtgaaagagatgagaatgtt

SEQ ID NO: 1846 - DNA, 49 bp, Artificial Sequence
  Description of Artificial Sequence: Synthetic oligonucleotide
gcagcaagccctgtgcccgagatgattcaatgaaagtgaaagatgaata

SEQ ID NO: 1847 - DNA, 49 bp, Artificial Sequence; identical to SEQ ID NO: 1846
  Description of Artificial Sequence: Synthetic oligonucleotide

SEQ ID NO: 1848 - DNA, 49 bp, Artificial Sequence; identical to SEQ ID NO: 1846
  Description of Artificial Sequence: Synthetic oligonucleotide

SEQ ID NO: 1849 - DNA, 49 bp, Artificial Sequence; identical to SEQ ID NO: 1846
  Description of Artificial Sequence: Synthetic oligonucleotide

SEQ ID NO: 1850 - DNA, 49 bp, Artificial Sequence; identical to SEQ ID NO: 1846
  Description of Artificial Sequence: Synthetic oligonucleotide

SEQ ID NO: 1851 - DNA, 49 bp, Artificial Sequence; identical to SEQ ID NO: 1846
  Description of Artificial Sequence: Synthetic oligonucleotide

SEQ ID NO: 1852 - DNA, 100 bp, Artificial Sequence
  Description of Artificial Sequence: Synthetic polynucleotide
agaggatggaacacagcggtgtgagaagtgcagcaagccctgtgcccgagtgtgctatggtctgggcatggagcacttgcgagaggtgagggcagttacc

SEQ ID NO: 1853 - DNA, 50 bp, Artificial Sequence
  Description of Artificial Sequence: Synthetic oligonucleotide
aagccctgtgcccgagtgtgctatggtctgggcatggagcacttgcgaga

SEQ ID NO: 1854 - DNA, 50 bp, Artificial Sequence
  Description of Artificial Sequence: Synthetic oligonucleotide
gtgcccgagtgtgctatggtctgggcatggagcacttgcgagaggtgagg

SEQ ID NO: 1855 - DNA, 50 bp, Artificial Sequence; identical to SEQ ID NO: 1854
  Description of Artificial Sequence: Synthetic oligonucleotide

SEQ ID NO: 1856 - DNA, 50 bp, Artificial Sequence; identical to SEQ ID NO: 1854
  Description of Artificial Sequence: Synthetic oligonucleotide

SEQ ID NO: 1857 - DNA, 50 bp, Artificial Sequence; identical to SEQ ID NO: 1854
  Description of Artificial Sequence: Synthetic oligonucleotide

SEQ ID NO: 1858 - DNA, 50 bp, Artificial Sequence; identical to SEQ ID NO: 1854
  Description of Artificial Sequence: Synthetic oligonucleotide

SEQ ID NO: 1859 - DNA, 50 bp, Artificial Sequence; identical to SEQ ID NO: 1854
  Description of Artificial Sequence: Synthetic oligonucleotide

SEQ ID NO: 1860 - DNA, 50 bp, Artificial Sequence; identical to SEQ ID NO: 1854
  Description of Artificial Sequence: Synthetic oligonucleotide

SEQ ID NO: 1861 - DNA, 50 bp, Artificial Sequence; identical to SEQ ID NO: 1854
  Description of Artificial Sequence: Synthetic oligonucleotide

SEQ ID NO: 1862 - DNA, 50 bp, Artificial Sequence; identical to SEQ ID NO: 1854
  Description of Artificial Sequence: Synthetic oligonucleotide

SEQ ID NO: 1863 - DNA, 50 bp, Artificial Sequence; identical to SEQ ID NO: 1854
  Description of Artificial Sequence: Synthetic oligonucleotide

SEQ ID NO: 1864 - DNA, 50 bp, Artificial Sequence
  Description of Artificial Sequence: Synthetic oligonucleotide
gcccgagtgtgctatggtttgggcatggagcacttgcgagaggtgagggc

SEQ ID NO: 1865 - DNA, 50 bp, Artificial Sequence; identical to SEQ ID NO: 1864
  Description of Artificial Sequence: Synthetic oligonucleotide

SEQ ID NO: 1866 - DNA, 50 bp, Artificial Sequence
  Description of Artificial Sequence: Synthetic oligonucleotide
gcccgagtgtgctatggtctgggcatggagcacttgcgagaggtgagggc

SEQ ID NO: 1867 - DNA, 50 bp, Artificial Sequence; identical to SEQ ID NO: 1866
  Description of Artificial Sequence: Synthetic oligonucleotide

SEQ ID NO: 1868 - DNA, 50 bp, Artificial Sequence; identical to SEQ ID NO: 1864
  Description of Artificial Sequence: Synthetic oligonucleotide

SEQ ID NO: 1869 - DNA, 50 bp, Artificial Sequence; identical to SEQ ID NO: 1866
  Description of Artificial Sequence: Synthetic oligonucleotide

SEQ ID NO: 1870 - DNA, 100 bp, Artificial Sequence; identical to SEQ ID NO: 1815
  Description of Artificial Sequence: Synthetic polynucleotide

SEQ ID NO: 1871 - DNA, 100 bp, Artificial Sequence
  Description of Artificial Sequence: Synthetic polynucleotide
agaggatggaacacagcggtgtgagaagtgcagcaagccctgtgcccgaggtacccactcactgcccccgaggccagctgcagttcctgtccctctgcgc

SEQ ID NO: 1872 - DNA, 100 bp, Artificial Sequence; identical to SEQ ID NO: 1842
  Description of Artificial Sequence: Synthetic polynucleotide

SEQ ID NO: 1873 - DNA, 50 bp, Artificial Sequence; identical to SEQ ID NO: 1843
  Description of Artificial Sequence: Synthetic oligonucleotide

SEQ ID NO: 1874 - DNA, 50 bp, Artificial Sequence; identical to SEQ ID NO: 1843
  Description of Artificial Sequence: Synthetic oligonucleotide

SEQ ID NO: 1875 - DNA, 100 bp, Artificial Sequence
  Description of Artificial Sequence: Synthetic polynucleotide
tgcaagaagatctttgggagcctggcatttctgccggagagctttgatggatgattcaatgaaagtgaaagatgaatacagtgaaagagatgagaatgtt

SEQ ID NO: 1876 - DNA, 50 bp, Artificial Sequence
  Description of Artificial Sequence: Synthetic oligonucleotide
ttgggagcctggcatttctgccggagagctttgatggatgattcaatgaa

SEQ ID NO: 1877 - DNA, 50 bp, Artificial Sequence; identical to SEQ ID NO: 1876
  Description of Artificial Sequence: Synthetic oligonucleotide

SEQ ID NO: 1878 - DNA, 50 bp, Artificial Sequence; identical to SEQ ID NO: 1876
  Description of Artificial Sequence: Synthetic oligonucleotide

SEQ ID NO: 1879 - DNA, 50 bp, Artificial Sequence; identical to SEQ ID NO: 1876
  Description of Artificial Sequence: Synthetic oligonucleotide

SEQ ID NO: 1880 - DNA, 50 bp, Artificial Sequence
  Description of Artificial Sequence: Synthetic oligonucleotide
  modified_base (50)..(50): a, c, t, g, unknown or other
ttgggagcctggcatttctgccggagagctttgatggatgattcaatgan

SEQ ID NO: 1881 - DNA, 50 bp, Artificial Sequence
  Description of Artificial Sequence: Synthetic oligonucleotide
ttgggagcctggcatttctgccggagagctttgatggatgatttaatgaa

SEQ ID NO: 1882 - DNA, 50 bp, Artificial Sequence; identical to SEQ ID NO: 1881
  Description of Artificial Sequence: Synthetic oligonucleotide

SEQ ID NO: 1883 - DNA, 50 bp, Artificial Sequence; identical to SEQ ID NO: 1876
  Description of Artificial Sequence: Synthetic oligonucleotide

SEQ ID NO: 1884 - DNA, 50 bp, Artificial Sequence; identical to SEQ ID NO: 1881
  Description of Artificial Sequence: Synthetic oligonucleotide

SEQ ID NO: 1885 - DNA, 50 bp, Artificial Sequence; identical to SEQ ID NO: 1876
  Description of Artificial Sequence: Synthetic oligonucleotide

SEQ ID NO: 1886 - DNA, 50 bp, Artificial Sequence; identical to SEQ ID NO: 1876
  Description of Artificial Sequence: Synthetic oligonucleotide

SEQ ID NO: 1887 - DNA, 50 bp, Artificial Sequence; identical to SEQ ID NO: 1881
  Description of Artificial Sequence: Synthetic oligonucleotide

SEQ ID NO: 1888 - DNA, 50 bp, Artificial Sequence; identical to SEQ ID NO: 1876
  Description of Artificial Sequence: Synthetic oligonucleotide

SEQ ID NO: 1889 - DNA, 50 bp, Artificial Sequence; identical to SEQ ID NO: 1876
  Description of Artificial Sequence: Synthetic oligonucleotide

SEQ ID NO: 1890 - DNA, 50 bp, Artificial Sequence; identical to SEQ ID NO: 1876
  Description of Artificial Sequence: Synthetic oligonucleotide

SEQ ID NO: 1891 - DNA, 50 bp, Artificial Sequence; identical to SEQ ID NO: 1876
  Description of Artificial Sequence: Synthetic oligonucleotide

SEQ ID NO: 1892 - DNA, 50 bp, Artificial Sequence
  Description of Artificial Sequence: Synthetic oligonucleotide
tgggagcctggcatttctgccggagagctttgatggatgattcaatgaaa

SEQ ID NO: 1893 - DNA, 50 bp, Artificial Sequence; identical to SEQ ID NO: 1892
  Description of Artificial Sequence: Synthetic oligonucleotide

SEQ ID NO: 1894 - DNA, 50 bp, Artificial Sequence; identical to SEQ ID NO: 1892
  Description of Artificial Sequence: Synthetic oligonucleotide

SEQ ID NO: 1895 - DNA, 48 bp, Artificial Sequence
  Description of Artificial Sequence: Synthetic oligonucleotide
tgggagcctggcatttctgccggagagctttgatggatgattcaatga

SEQ ID NO: 1896 - DNA, 50 bp, Artificial Sequence
  Description of Artificial Sequence: Synthetic oligonucleotide
tgggagcctggcatttctgccggagagttttgatggatgattcaatgaaa

SEQ ID NO: 1897 - DNA, 50 bp, Artificial Sequence; identical to SEQ ID NO: 1892
  Description of Artificial Sequence: Synthetic oligonucleotide

SEQ ID NO: 1898 - DNA, 50 bp, Artificial Sequence; identical to SEQ ID NO: 1896
  Description of Artificial Sequence: Synthetic oligonucleotide

SEQ ID NO: 1899 - DNA, 50 bp, Artificial Sequence; identical to SEQ ID NO: 1892
  Description of Artificial Sequence: Synthetic oligonucleotide

SEQ ID NO: 1900 - DNA, 50 bp, Artificial Sequence; identical to SEQ ID NO: 1892
  Description of Artificial Sequence: Synthetic oligonucleotide

SEQ ID NO: 1901 - DNA, 50 bp, Artificial Sequence; identical to SEQ ID NO: 1892
  Description of Artificial Sequence: Synthetic oligonucleotide

SEQ ID NO: 1902 - DNA, 50 bp, Artificial Sequence; identical to SEQ ID NO: 1892
  Description of Artificial Sequence: Synthetic oligonucleotide

SEQ ID NO: 1903 - DNA, 50 bp, Artificial Sequence; identical to SEQ ID NO: 1892
  Description of Artificial Sequence: Synthetic oligonucleotide

SEQ ID NO: 1904 - DNA, 50 bp, Artificial Sequence; identical to SEQ ID NO: 1892
  Description of Artificial Sequence: Synthetic oligonucleotide

SEQ ID NO: 1905 - DNA, 50 bp, Artificial Sequence; identical to SEQ ID NO: 1892
  Description of Artificial Sequence: Synthetic oligonucleotide

SEQ ID NO: 1906 - DNA, 50 bp, Artificial Sequence; identical to SEQ ID NO: 1892
  Description of Artificial Sequence: Synthetic oligonucleotide

SEQ ID NO: 1907 - DNA, 50 bp, Artificial Sequence; identical to SEQ ID NO: 1892
  Description of Artificial Sequence: Synthetic oligonucleotide

SEQ ID NO: 1908 - DNA, 50 bp, Artificial Sequence; identical to SEQ ID NO: 1896
  Description of Artificial Sequence: Synthetic oligonucleotide

SEQ ID NO: 1909 - DNA, 50 bp, Artificial Sequence; identical to SEQ ID NO: 1892
  Description of Artificial Sequence: Synthetic oligonucleotide

SEQ ID NO: 1910 - DNA, 50 bp, Artificial Sequence; identical to SEQ ID NO: 1896
  Description of Artificial Sequence: Synthetic oligonucleotide

SEQ ID NO: 1911 - DNA, 50 bp, Artificial Sequence; identical to SEQ ID NO: 1892
  Description of Artificial Sequence: Synthetic oligonucleotide

SEQ ID NO: 1912 - DNA, 50 bp, Artificial Sequence; identical to SEQ ID NO: 1892
  Description of Artificial Sequence: Synthetic oligonucleotide

SEQ ID NO: 1913 - DNA, 50 bp, Artificial Sequence
  Description of Artificial Sequence: Synthetic oligonucleotide
gggagcctggcatttctgccggagagctttgatggatgattcaatgaaag

SEQ ID NO: 1914 - DNA, 50 bp, Artificial Sequence; identical to SEQ ID NO: 1913
  Description of Artificial Sequence: Synthetic oligonucleotide

SEQ ID NO: 1915 - DNA, 50 bp, Artificial Sequence
  Description of Artificial Sequence: Synthetic oligonucleotide
gccggagagctttgatggatgattcaatgaaagtgaaagatgaatacagt

SEQ ID NO: 1916 - DNA, 50 bp, Artificial Sequence; identical to SEQ ID NO: 1915
  Description of Artificial Sequence: Synthetic oligonucleotide

SEQ ID NO: 1917 - DNA, 50 bp, Artificial Sequence
  Description of Artificial Sequence: Synthetic oligonucleotide
gccggagagctttgatggatgattcaatgaaagggaaagatgaatacagt

SEQ ID NO: 1918 - DNA, 50 bp, Artificial Sequence; identical to SEQ ID NO: 1915
  Description of Artificial Sequence: Synthetic oligonucleotide

SEQ ID NO: 1919 - DNA, 50 bp, Artificial Sequence; identical to SEQ ID NO: 1915
  Description of Artificial Sequence: Synthetic oligonucleotide

SEQ ID NO: 1920 - DNA, 50 bp, Artificial Sequence
  Description of Artificial Sequence: Synthetic oligonucleotide
gccggagagctctgatggatgattcaatgaaagtgaaagatgaatacagt

SEQ ID NO: 1921 - DNA, 50 bp, Artificial Sequence; identical to SEQ ID NO: 1915
  Description of Artificial Sequence: Synthetic oligonucleotide

SEQ ID NO: 1922 - DNA, 50 bp, Artificial Sequence; identical to SEQ ID NO: 1915
  Description of Artificial Sequence: Synthetic oligonucleotide

SEQ ID NO: 1923 - DNA, 49 bp, Artificial Sequence
  Description of Artificial Sequence: Synthetic oligonucleotide
gccggagagctttgatggatgattcaatgaaagtgaaagatgaatacag

SEQ ID NO: 1924 - DNA, 50 bp, Artificial Sequence; identical to SEQ ID NO: 1915
  Description of Artificial Sequence: Synthetic oligonucleotide

SEQ ID NO: 1925 - DNA, 50 bp, Artificial Sequence; identical to SEQ ID NO: 1915
  Description of Artificial Sequence: Synthetic oligonucleotide

SEQ ID NO: 1926 - DNA, 50 bp, Artificial Sequence; identical to SEQ ID NO: 1915
  Description of Artificial Sequence: Synthetic oligonucleotide

SEQ ID NO: 1927 - DNA, 50 bp, Artificial Sequence; identical to SEQ ID NO: 1915
  Description of Artificial Sequence: Synthetic oligonucleotide

SEQ ID NO: 1928 - DNA, 50 bp, Artificial Sequence
  Description of Artificial Sequence: Synthetic oligonucleotide
gccggagagcttggatggatgattcaatgaaagtgaaagatgaatacagt

SEQ ID NO: 1929 - DNA, 50 bp, Artificial Sequence; identical to SEQ ID NO: 1915
  Description of Artificial Sequence: Synthetic oligonucleotide

SEQ ID NO: 1930 - DNA, 50 bp, Artificial Sequence; identical to SEQ ID NO: 1915
  Description of Artificial Sequence: Synthetic oligonucleotide

SEQ ID NO: 1931 - DNA, 50 bp, Artificial Sequence; identical to SEQ ID NO: 1915
  Description of Artificial Sequence: Synthetic oligonucleotide

SEQ ID NO: 1932 - DNA, 50 bp, Artificial Sequence; identical to SEQ ID NO: 1915
  Description of Artificial Sequence: Synthetic oligonucleotide

SEQ ID NO: 1933 - DNA, 50 bp, Artificial Sequence; identical to SEQ ID NO: 1915
  Description of Artificial Sequence: Synthetic oligonucleotide

SEQ ID NO: 1934 - DNA, 50 bp, Artificial Sequence; identical to SEQ ID NO: 1915
  Description of Artificial Sequence: Synthetic oligonucleotide

SEQ ID NO: 1935 - DNA, 47 bp, Artificial Sequence
  Description of Artificial Sequence: Synthetic oligonucleotide
gccggagagctttgatggatgattcaatgaaagtgaaagatgaatac

SEQ ID NO: 1936 - DNA, 50 bp, Artificial Sequence; identical to SEQ ID NO: 1915
  Description of Artificial Sequence: Synthetic oligonucleotide

SEQ ID NO: 1937 - DNA, 50 bp, Artificial Sequence; identical to SEQ ID NO: 1915
  Description of Artificial Sequence: Synthetic oligonucleotide

SEQ ID NO: 1938 - DNA, 50 bp, Artificial Sequence; identical to SEQ ID NO: 1915
  Description of Artificial Sequence: Synthetic oligonucleotide

SEQ ID NO: 1939 - DNA, 50 bp, Artificial Sequence; identical to SEQ ID NO: 1915
  Description of Artificial Sequence: Synthetic oligonucleotide

SEQ ID NO: 1940 - DNA, 50 bp, Artificial Sequence; identical to SEQ ID NO: 1915
  Description of Artificial Sequence: Synthetic oligonucleotide

SEQ ID NO: 1941 - DNA, 50 bp, Artificial Sequence; identical to SEQ ID NO: 1915
  Description of Artificial Sequence: Synthetic oligonucleotide

SEQ ID NO: 1942 - DNA, 50 bp, Artificial Sequence
  Description of Artificial Sequence: Synthetic oligonucleotide
gccggggagctttgatggatgattcaatgaaagtgaaagatgaatacagt

SEQ ID NO: 1943 - DNA, 49 bp, Artificial Sequence; identical to SEQ ID NO: 1923
  Description of Artificial Sequence: Synthetic oligonucleotide

SEQ ID NO: 1944 - DNA, 50 bp, Artificial Sequence; identical to SEQ ID NO: 1915
  Description of Artificial Sequence: Synthetic oligonucleotide

SEQ ID NO: 1945 - DNA, 50 bp, Artificial Sequence
  Description of Artificial Sequence: Synthetic oligonucleotide
tttgatggatgattcaatgaaagtgaaagatgaatacagtgaaacagatg

SEQ ID NO: 1946 - DNA, 50 bp, Artificial Sequence; identical to SEQ ID NO: 1945
  Description of Artificial Sequence: Synthetic oligonucleotide

SEQ ID NO: 1947 - DNA, 50 bp, Artificial Sequence; identical to SEQ ID NO: 1945
  Description of Artificial Sequence: Synthetic oligonucleotide

SEQ ID NO: 1948 - DNA, 50 bp, Artificial Sequence; identical to SEQ ID NO: 1945
  Description of Artificial Sequence: Synthetic oligonucleotide

SEQ ID NO: 1949 - DNA, 50 bp, Artificial Sequence; identical to SEQ ID NO: 1945
  Description of Artificial Sequence: Synthetic oligonucleotide

SEQ ID NO: 1950 - DNA, 50 bp, Artificial Sequence
  Description of Artificial Sequence: Synthetic oligonucleotide
ttgatggatgattcaatgaaagtgaaagatgaatacagtgaaagagatga

SEQ ID NO: 1951 - DNA, 50 bp, Artificial Sequence; identical to SEQ ID NO: 1950
  Description of Artificial Sequence: Synthetic oligonucleotide

SEQ ID NO: 1952 - DNA, 50 bp, Artificial Sequence; identical to SEQ ID NO: 1950
  Description of Artificial Sequence: Synthetic oligonucleotide

SEQ ID NO: 1953 - DNA, 50 bp, Artificial Sequence; identical to SEQ ID NO: 1950
  Description of Artificial Sequence: Synthetic oligonucleotide

SEQ ID NO: 1954 - DNA, 50 bp, Artificial Sequence; identical to SEQ ID NO: 1950
  Description of Artificial Sequence: Synthetic oligonucleotide

SEQ ID NO: 1955 - DNA, 100 bp, Artificial Sequence
  Description of Artificial Sequence: Synthetic polynucleotide
tgcaagaagatctttgggagcctggcatttctgccggagagctttgatggggacccagcctccaacactgccccgctccagccagagcagctccaagtgt

SEQ ID NO: 1956 - DNA, 50 bp, Artificial Sequence
  Description of Artificial Sequence: Synthetic oligonucleotide
ggcatttctgccggagagctttgatggggacccagcctccaacactgccc

SEQ ID NO: 1957 - DNA, 50 bp, Artificial Sequence; identical to SEQ ID NO: 1956
  Description of Artificial Sequence: Synthetic oligonucleotide

SEQ ID NO: 1958 - DNA, 50 bp, Artificial Sequence; identical to SEQ ID NO: 1956
  Description of Artificial Sequence: Synthetic oligonucleotide

SEQ ID NO: 1959 - DNA, 50 bp, Artificial Sequence
  Description of Artificial Sequence: Synthetic oligonucleotide
ggcatttctgccggagagctttgatggggacccagcctccaatactgccc

SEQ ID NO: 1960 - DNA, 50 bp, Artificial Sequence; identical to SEQ ID NO: 1956
  Description of Artificial Sequence: Synthetic oligonucleotide

SEQ ID NO: 1961 - DNA, 50 bp, Artificial Sequence; identical to SEQ ID NO: 1956
  Description of Artificial Sequence: Synthetic oligonucleotide

SEQ ID NO: 1962 - DNA, 50 bp, Artificial Sequence; identical to SEQ ID NO: 1956
  Description of Artificial Sequence: Synthetic oligonucleotide

SEQ ID NO: 1963 - DNA, 50 bp, Artificial Sequence
  Description of Artificial Sequence: Synthetic oligonucleotide
ctgccggagagctttgatggggacccagcctccaacactgccccgctcca

SEQ ID NO: 1964 - DNA, 50 bp, Artificial Sequence; identical to SEQ ID NO: 1963
  Description of Artificial Sequence: Synthetic oligonucleotide

SEQ ID NO: 1965 - DNA, 50 bp, Artificial Sequence
  Description of Artificial Sequence: Synthetic oligonucleotide
tgccggagagctttgatggggacccagcctccaacactgccccgctccag

SEQ ID NO: 1966 - DNA, 50 bp, Artificial Sequence; identical to SEQ ID NO: 1965
  Description of Artificial Sequence: Synthetic oligonucleotide

SEQ ID NO: 1967 - DNA, 50 bp, Artificial Sequence; identical to SEQ ID NO: 1965
  Description of Artificial Sequence: Synthetic oligonucleotide

SEQ ID NO: 1968 - DNA, 50 bp, Artificial Sequence; identical to SEQ ID NO: 1965
  Description of Artificial Sequence: Synthetic oligonucleotide

SEQ ID NO: 1969 - DNA, 50 bp, Artificial Sequence; identical to SEQ ID NO: 1965
  Description of Artificial Sequence: Synthetic oligonucleotide

SEQ ID NO: 1970 - DNA, 50 bp, Artificial Sequence; identical to SEQ ID NO: 1965
  Description of Artificial Sequence: Synthetic oligonucleotide

SEQ ID NO: 1971 - DNA, 50 bp, Artificial Sequence; identical to SEQ ID NO: 1965
  Description of Artificial Sequence: Synthetic oligonucleotide

SEQ ID NO: 1972 - DNA, 50 bp, Artificial Sequence
  Description of Artificial Sequence: Synthetic oligonucleotide
tgccggagagctatgatggggacccagcctccaacactgccccgctccag

SEQ ID NO: 1973 - DNA, 50 bp, Artificial Sequence; identical to SEQ ID NO: 1965
  Description of Artificial Sequence: Synthetic oligonucleotide

SEQ ID NO: 1974 - DNA, 50 bp, Artificial Sequence; identical to SEQ ID NO: 1965
  Description of Artificial Sequence: Synthetic oligonucleotide

SEQ ID NO: 1975 - DNA, 50 bp, Artificial Sequence; identical to SEQ ID NO: 1965
  Description of Artificial Sequence: Synthetic oligonucleotide

SEQ ID NO: 1976 - DNA, 50 bp, Artificial Sequence; identical to SEQ ID NO: 1965
  Description of Artificial Sequence: Synthetic oligonucleotide

SEQ ID NO: 1977 - DNA, 50 bp, Artificial Sequence; identical to SEQ ID NO: 1965
  Description of Artificial Sequence: Synthetic oligonucleotide

SEQ ID NO: 1978 - DNA, 50 bp, Artificial Sequence; identical to SEQ ID NO: 1965
  Description of Artificial Sequence: Synthetic oligonucleotide

SEQ ID NO: 1979 - DNA, 50 bp, Artificial Sequence; identical to SEQ ID NO: 1965
  Description of Artificial Sequence: Synthetic oligonucleotide

SEQ ID NO: 1980 - DNA, 50 bp, Artificial Sequence
  Description of Artificial Sequence: Synthetic oligonucleotide
gccggagagctttgatggggacccagcctccaacactgccccgctccagc

SEQ ID NO: 1981 - DNA, 50 bp, Artificial Sequence
  Description of Artificial Sequence: Synthetic oligonucleotide
gccggagagctttgatggggacccagccttcaacactgccccgctccagc

SEQ ID NO: 1982 - DNA, 50 bp, Artificial Sequence; identical to SEQ ID NO: 1980
  Description of Artificial Sequence: Synthetic oligonucleotide

SEQ ID NO: 1983 - DNA, 50 bp, Artificial Sequence; identical to SEQ ID NO: 1980
  Description of Artificial Sequence: Synthetic oligonucleotide

SEQ ID NO: 1984 - DNA, 50 bp, Artificial Sequence; identical to SEQ ID NO: 1980
  Description of Artificial Sequence: Synthetic oligonucleotide

SEQ ID NO: 1985 - DNA, 50 bp, Artificial Sequence; identical to SEQ ID NO: 1980
  Description of Artificial Sequence: Synthetic oligonucleotide

SEQ ID NO: 1986 - DNA, 50 bp, Artificial Sequence; identical to SEQ ID NO: 1980
  Description of Artificial Sequence: Synthetic oligonucleotide

SEQ ID NO: 1987 - DNA, 50 bp, Artificial Sequence; identical to SEQ ID NO: 1980
  Description of Artificial Sequence: Synthetic oligonucleotide

SEQ ID NO: 1988 - DNA, 50 bp, Artificial Sequence; identical to SEQ ID NO: 1980
  Description of Artificial Sequence: Synthetic oligonucleotide

SEQ ID NO: 1989 - DNA, 50 bp, Artificial Sequence; identical to SEQ ID NO: 1980
  Description of Artificial Sequence: Synthetic oligonucleotide

SEQ ID NO: 1990 - DNA, 50 bp, Artificial Sequence; identical to SEQ ID NO: 1980
  Description of Artificial Sequence: Synthetic oligonucleotide

SEQ ID NO: 1991 - DNA, 50 bp, Artificial Sequence; identical to SEQ ID NO: 1981
  Description of Artificial Sequence: Synthetic oligonucleotide

SEQ ID NO: 1992 - DNA, 50 bp, Artificial Sequence; identical to SEQ ID NO: 1980
  Description of Artificial Sequence: Synthetic oligonucleotide

SEQ ID NO: 1993 - DNA, 50 bp, Artificial Sequence; identical to SEQ ID NO: 1980
  Description of Artificial Sequence: Synthetic oligonucleotide

SEQ ID NO: 1994 - DNA, 50 bp, Artificial Sequence; identical to SEQ ID NO: 1980
  Description of Artificial Sequence: Synthetic oligonucleotide

SEQ ID NO: 1995 - DNA, 100 bp, Artificial Sequence; identical to SEQ ID NO: 1815
  Description of Artificial Sequence: Synthetic polynucleotide

SEQ ID NO: 1996 - DNA, 100 bp, Artificial Sequence
  Description of Artificial Sequence: Synthetic polynucleotide
tgcaagaagatctttgggagcctggcatttctgccggagagctttgatgggtaagagtgggcacgatgacctgagacagtgtcagggcagacagagtcct

SEQ ID NO: 1997 - DNA, 100 bp, Artificial Sequence; identical to SEQ ID NO: 1842
  Description of Artificial Sequence: Synthetic polynucleotide

SEQ ID NO: 1998 - DNA, 50 bp, Artificial Sequence; identical to SEQ ID NO: 1843
  Description of Artificial Sequence: Synthetic oligonucleotide

SEQ ID NO: 1999 - DNA, 50 bp, Artificial Sequence; identical to SEQ ID NO: 1843
  Description of Artificial Sequence: Synthetic oligonucleotide

SEQ ID NO: 2000 - DNA, 100 bp, Artificial Sequence
  Description of Artificial Sequence: Synthetic polynucleotide
cctttcctttgcaattcagtgcagtaggatactgaaactgacattatttggaaaatctacttcctcatcaagcacccctacagagttctgcaggaatggt

SEQ ID NO: 2001 - DNA, 50 bp, Artificial Sequence
  Description of Artificial Sequence: Synthetic oligonucleotide
gcaattcagtgcagtaggatactgaaactgacattatttggaaaatctac

SEQ ID NO: 2002 - DNA, 50 bp, Artificial Sequence; identical to SEQ ID NO: 2001
  Description of Artificial Sequence: Synthetic oligonucleotide

SEQ ID NO: 2003 - DNA, 50 bp, Artificial Sequence; identical to SEQ ID NO: 2001
  Description of Artificial Sequence: Synthetic oligonucleotide

SEQ ID NO: 2004 - DNA, 100 bp, Artificial Sequence
  Description of Artificial Sequence: Synthetic polynucleotide
cctttcctttgcaattcagtgcagtaggatactgaaactgacattatttgttaatggccagccaagaccccttgaatcaagtcaggtgaaatatctccgt

SEQ ID NO: 2005 - DNA, 100 bp, Artificial Sequence
  Description of Artificial Sequence: Synthetic polynucleotide
catcattttgggactgggcatctggaggattgtgatcaggatccaaagaggaaaatctacttcctcatcaagcacccctacagagttctgcaggaatggt

SEQ ID NO: 2006 - DNA, 100 bp, Artificial Sequence
  Description of Artificial Sequence: Synthetic polynucleotide
cctttcctttgcaattcagtgcagtaggatactgaaactgacattatttggtgagtagtaaactttctaatgaatttactattttattcattgtatttta

SEQ ID NO: 2007 - DNA, 100 bp, Artificial Sequence
  Description of Artificial Sequence: Synthetic polynucleotide
gaaatgaatcagccagttcatgactattctgttatttattgtttctttaggaaaatctacttcctcatcaagcacccctacagagttctgcaggaatggt

SEQ ID NO: 2008 - DNA, 100 bp, Artificial Sequence
  Description of Artificial Sequence: Synthetic polynucleotide
tcttggctggttggtctgtggagtgcctgaagtgaccagctttttgtaaggtcaactttgtagtgtgccaactctttgccttgctagcagccatttggtt

SEQ ID NO: 2009 - DNA, 50 bp, Artificial Sequence
  Description of Artificial Sequence: Synthetic oligonucleotide
gtggagtgcctgaagtgaccagctttttgtaaggtcaactttgtagtgtg

SEQ ID NO: 2010 - DNA, 100 bp, Artificial Sequence
  Description of Artificial Sequence: Synthetic polynucleotide
tcttggctggttggtctgtggagtgcctgaagtgaccagctttttgtaagtagctgcagctgaggacagccaccctttcttcgtctctgctgagcgaagg

SEQ ID NO: 2011 - DNA, 100 bp, Artificial Sequence
  Description of Artificial Sequence: Synthetic polynucleotide
ccaccctgctgcagcccctcagcaacgccgtgcagctgcccatcgaccaggtcaactttgtagtgtgccaactctttgccttgctagcagccatttggtt

SEQ ID NO: 2012 - DNA, 50 bp, Artificial Sequence
  Description of Artificial Sequence: Synthetic oligonucleotide
cgccgtgcagctgcccatcgaccaggtcaactttgtagtgtgccaactct

SEQ ID NO: 2013 - DNA, 50 bp, Artificial Sequence
  Description of Artificial Sequence: Synthetic oligonucleotide
gcagctgcccatcgaccaggtcaactttgtagtgtgccaactctttgcct

SEQ ID NO: 2014 - DNA, 50 bp, Artificial Sequence; identical to SEQ ID NO: 2013
  Description of Artificial Sequence: Synthetic oligonucleotide

SEQ ID NO: 2015 - DNA, 50 bp, Artificial Sequence
  Description of Artificial Sequence: Synthetic oligonucleotide
gcccatcgaccaggtcaactttgtagtgtgccaactctttgccttgctag

SEQ ID NO: 2016 - DNA, 50 bp, Artificial Sequence; identical to SEQ ID NO: 2015
  Description of Artificial Sequence: Synthetic oligonucleotide

SEQ ID NO: 2017 - DNA, 100 bp, Artificial Sequence
  Description of Artificial Sequence: Synthetic polynucleotide
tcttggctggttggtctgtggagtgcctgaagtgaccagctttttgtaaggtacggtttatttgactttgcaagcgagcacctgctttgggggttggaga

SEQ ID NO: 2018 - DNA, 100 bp, Artificial Sequence
  Description of Artificial Sequence: Synthetic polynucleotide
aaaaattcaggtctgtgttgctaatacaaaattttaatttttctttacaggtcaactttgtagtgtgccaactctttgccttgctagcagccatttggtt

SEQ ID NO: 2019 - DNA, 100 bp, Artificial Sequence
  Description of Artificial Sequence: Synthetic polynucleotide
cgtccccaggagactcgcaggagcaacacgtgatgtgtctacttatcaggtcaaaccggcacgatgtccaggcaccagaaccagaacaccatccaggagc

SEQ ID NO: 2020 - DNA, 50 bp, Artificial Sequence
  Description of Artificial Sequence: Synthetic oligonucleotide
cgcaggagcaacacgtgatgtgtctacttatcaggtcaaaccggcacgat

SEQ ID NO: 2021 - DNA, 100 bp, Artificial Sequence
  Description of Artificial Sequence: Synthetic polynucleotide
cgtccccaggagactcgcaggagcaacacgtgatgtgtctacttatcagggttgctccgactgtgtgttccaggagtggtggctctgaggtgtgaccctg

SEQ ID NO: 2022 - DNA, 100 bp, Artificial Sequence
  Description of Artificial Sequence: Synthetic polynucleotide
tactattctcggcgcggcgtgatcaccgaccagaactcggacggctactgtcaaaccggcacgatgtccaggcaccagaaccagaacaccatccaggagc

SEQ ID NO: 2023 - DNA, 100 bp, Artificial Sequence
  Description of Artificial Sequence: Synthetic polynucleotide
cgtccccaggagactcgcaggagcaacacgtgatgtgtctacttatcagggtgagagggggagagcgagactccgagcgtgcgggcgaggaagctgggcg

SEQ ID NO: 2024 - DNA, 100 bp, Artificial Sequence
  Description of Artificial Sequence: Synthetic polynucleotide
aattgaaataggttatttgatgtctggtttctctgtgtttgcctccttagtcaaaccggcacgatgtccaggcaccagaaccagaacaccatccaggagc

SEQ ID NO: 2025 - DNA, 100 bp, Artificial Sequence
  Description of Artificial Sequence: Synthetic polynucleotide
ggcggagggggcgccgcgggcgggcgatgtgagcgcggcgctctggacaggactgaatttgctcttaaagaaatcatgtcctctggaggtgctgaagatg

SEQ ID NO: 2026 - DNA, 50 bp, Artificial Sequence
  Description of Artificial Sequence: Synthetic oligonucleotide
cggcgctctggacaggactgaatttactcttaaagaaatcatgtcctctg

SEQ ID NO: 2027 - DNA, 50 bp, Artificial Sequence; identical to SEQ ID NO: 2026
  Description of Artificial Sequence: Synthetic oligonucleotide

SEQ ID NO: 2028 - DNA, 100 bp, Artificial Sequence
  Description of Artificial Sequence: Synthetic polynucleotide
ggcggagggggcgccgcgggcgggcgatgtgagcgcggcgctctggacagagtacgcttcatgtcagtagaaatggacagcagcagttttattcagtttg

SEQ ID NO: 2029 - DNA, 50 bp, Artificial Sequence
  Description of Artificial Sequence: Synthetic oligonucleotide
ggcgggcgatgtgagcgcggcgctctggacagagtacgcttcatgtcagt

SEQ ID NO: 2030 - DNA, 50 bp, Artificial Sequence; identical to SEQ ID NO: 2029
  Description of Artificial Sequence: Synthetic oligonucleotide

SEQ ID NO: 2031 - DNA, 50 bp, Artificial Sequence; identical to SEQ ID NO: 2029
  Description of Artificial Sequence: Synthetic oligonucleotide

SEQ ID NO: 2032 - DNA, 50 bp, Artificial Sequence; identical to SEQ ID NO: 2029
  Description of Artificial Sequence: Synthetic oligonucleotide

SEQ ID NO: 2033 - DNA, 50 bp, Artificial Sequence
  Description of Artificial Sequence: Synthetic oligonucleotide
cgggcgatgtgagcgcggcgctctggacagagtacgcttcatgtcagtag

SEQ ID NO: 2034 - DNA, 50 bp, Artificial Sequence; identical to SEQ ID NO: 2033
  Description of Artificial Sequence: Synthetic oligonucleotide

SEQ ID NO: 2035 - DNA, 50 bp, Artificial Sequence; identical to SEQ ID NO: 2033
  Description of Artificial Sequence: Synthetic oligonucleotide

SEQ ID NO: 2036 - DNA, 50 bp, Artificial Sequence; identical to SEQ ID NO: 2033
  Description of Artificial Sequence: Synthetic oligonucleotide

SEQ ID NO: 2037 - DNA, 50 bp, Artificial Sequence; identical to SEQ ID NO: 2033
  Description of Artificial Sequence: Synthetic oligonucleotide

SEQ ID NO: 2038 - DNA, 50 bp, Artificial Sequence
  Description of Artificial Sequence: Synthetic oligonucleotide
ggacagagtacgcttcatgtcagtagaaatggacagcagcagttttattc

SEQ ID NO: 2039 - DNA, 50 bp, Artificial Sequence; identical to SEQ ID NO: 2038
  Description of Artificial Sequence: Synthetic oligonucleotide

SEQ ID NO: 2040 - DNA, 50 bp, Artificial Sequence; identical to SEQ ID NO: 2038
  Description of Artificial Sequence: Synthetic oligonucleotide

SEQ ID NO: 2041 - DNA, 50 bp, Artificial Sequence; identical to SEQ ID NO: 2038
  Description of Artificial Sequence: Synthetic oligonucleotide

SEQ ID NO: 2042 - DNA, 50 bp, Artificial Sequence; identical to SEQ ID NO: 2038
  Description of Artificial Sequence: Synthetic oligonucleotide

SEQ ID NO: 2043 - DNA, 50 bp, Artificial Sequence; identical to SEQ ID NO: 2038
  Description of Artificial Sequence: Synthetic oligonucleotide

SEQ ID NO: 2044 - DNA, 50 bp, Artificial Sequence; identical to SEQ ID NO: 2038
  Description of Artificial Sequence: Synthetic oligonucleotide

SEQ ID NO: 2045 - DNA, 50 bp, Artificial Sequence; identical to SEQ ID NO: 2038
  Description of Artificial Sequence: Synthetic oligonucleotide

SEQ ID NO: 2046 - DNA, 50 bp, Artificial Sequence; identical to SEQ ID NO: 2038
  Description of Artificial Sequence: Synthetic oligonucleotide

SEQ ID NO: 2047 - DNA, 50 bp, Artificial Sequence; identical to SEQ ID NO: 2038
  Description of Artificial Sequence: Synthetic oligonucleotide

SEQ ID NO: 2048 - DNA, 100 bp, Artificial Sequence
  Description of Artificial Sequence: Synthetic polynucleotide
agcagtcattcacaatctcaaggggaaagatatcaacatttcactgaaaagactgaatttgctcttaaagaaatcatgtcctctggaggtgctgaagatg

SEQ ID NO: 2049 - DNA, 100 bp, Artificial Sequence
  Description of Artificial Sequence: Synthetic polynucleotide
ggcggagggggcgccgcgggcgggcgatgtgagcgcggcgctctggacaggtgaggcacgctggccgggggcggcgagcagcgggctaggcgcgggcggg

SEQ ID NO: 2050 - DNA, 100 bp, Artificial Sequence
  Description of Artificial Sequence: Synthetic polynucleotide
tctatttttatttttacctcctgcatgaatgaacatatgttttcttacaggactgaatttgctcttaaagaaatcatgtcctctggaggtgctgaagatg

SEQ ID NO: 2051 - DNA, 100 bp, Artificial Sequence
  Description of Artificial Sequence: Synthetic polynucleotide
gctgctgctgctgctgctggcgctgtgcggctgcccggcccccgccgcgggattctttctactaatccagatacttgttgaagtgctgactagtttcttg

SEQ ID NO: 2052 - DNA, 50 bp, Artificial Sequence
  Description of Artificial Sequence: Synthetic oligonucleotide
gctgctgctggcgctgtgcggctgcccggcccccgccgcgggattctttc

SEQ ID NO: 2053 - DNA, 50 bp, Artificial Sequence
  Description of Artificial Sequence: Synthetic oligonucleotide
ggcgctgtgcggctgcccggcccccgccgcgggattctttctactaatcc

SEQ ID NO: 2054 - DNA, 50 bp, Artificial Sequence; identical to SEQ ID NO: 2053
  Description of Artificial Sequence: Synthetic oligonucleotide

SEQ ID NO: 2055 - DNA, 50 bp, Artificial Sequence; identical to SEQ ID NO: 2053
  Description of Artificial Sequence: Synthetic oligonucleotide

SEQ ID NO: 2056 - DNA, 50 bp, Artificial Sequence; identical to SEQ ID NO: 2053
  Description of Artificial Sequence: Synthetic oligonucleotide

SEQ ID NO: 2057 - DNA, 48 bp, Artificial Sequence
  Description of Artificial Sequence: Synthetic oligonucleotide
ggcgctgtgcggctgcccggcccccgccgcgggattctttctactaat

SEQ ID NO: 2058 - DNA, 50 bp, Artificial Sequence; identical to SEQ ID NO: 2053
  Description of Artificial Sequence: Synthetic oligonucleotide

SEQ ID NO: 2059 - DNA, 50 bp, Artificial Sequence; identical to SEQ ID NO: 2053
  Description of Artificial Sequence: Synthetic oligonucleotide

SEQ ID NO: 2060 - DNA, 50 bp, Artificial Sequence
  Description of Artificial Sequence: Synthetic oligonucleotide
gtgcggctgcccggcccccgccgcgggattctttctactaatccagatac

SEQ ID NO: 2061 - DNA, 50 bp, Artificial Sequence; identical to SEQ ID NO: 2060
  Description of Artificial Sequence: Synthetic oligonucleotide

SEQ ID NO: 2062 - DNA, 50 bp, Artificial Sequence
  Description of Artificial Sequence: Synthetic oligonucleotide
gctgcccggtccccgccgcgggattctttctactaatccagatacttgtt

SEQ ID NO: 2063 - DNA, 50 bp, Artificial Sequence; identical to SEQ ID NO: 2062
  Description of Artificial Sequence: Synthetic oligonucleotide

SEQ ID NO: 2064 - DNA, 50 bp, Artificial Sequence
  Description of Artificial Sequence: Synthetic oligonucleotide
gcccggcccccgccgcgggattctttctactaatccagatacttgttgaa

SEQ ID NO: 2065 - DNA, 50 bp, Artificial Sequence; identical to SEQ ID NO: 2064
  Description of Artificial Sequence: Synthetic oligonucleotide

SEQ ID NO: 2066 - DNA, 50 bp, Artificial Sequence; identical to SEQ ID NO: 2064
  Description of Artificial Sequence: Synthetic oligonucleotide

SEQ ID NO: 2067 - DNA, 50 bp, Artificial Sequence; identical to SEQ ID NO: 2064
  Description of Artificial Sequence: Synthetic oligonucleotide

SEQ ID NO: 2068 - DNA, 50 bp, Artificial Sequence
  Description of Artificial Sequence: Synthetic oligonucleotide
cccgccgcgggattctttctactaatccagatacttgttgaagtgctgac

SEQ ID NO: 2069 - DNA, 50 bp, Artificial Sequence
  Description of Artificial Sequence: Synthetic oligonucleotide
cgccgcgggattctttctactaatccagatacttgttgaagtgctgacta

SEQ ID NO: 2070 - DNA, 50 bp, Artificial Sequence
  Description of Artificial Sequence: Synthetic oligonucleotide
gccgcgggattctttctactaatccagatacttgttgaagtgctgactag

SEQ ID NO: 2071 - DNA, 50 bp, Artificial Sequence; identical to SEQ ID NO: 2070
  Description of Artificial Sequence: Synthetic oligonucleotide

SEQ ID NO: 2072 - DNA, 50 bp, Artificial Sequence; identical to SEQ ID NO: 2070
  Description of Artificial Sequence: Synthetic oligonucleotide

SEQ ID NO: 2073 - DNA, 50 bp, Artificial Sequence; identical to SEQ ID NO: 2070
  Description of Artificial Sequence: Synthetic oligonucleotide

SEQ ID NO: 2074 - DNA, 50 bp, Artificial Sequence; identical to SEQ ID NO: 2070
  Description of Artificial Sequence: Synthetic oligonucleotide

SEQ ID NO: 2075 - DNA, 50 bp, Artificial Sequence; identical to SEQ ID NO: 2070
  Description of Artificial Sequence: Synthetic oligonucleotide

SEQ ID NO: 2076 - DNA, 50 bp, Artificial Sequence
  Description of Artificial Sequence: Synthetic oligonucleotide
ccgcgggattctttctactaatccagatacttgttgaagtgctgactagt

SEQ ID NO: 2077 - DNA, 50 bp, Artificial Sequence; identical to SEQ ID NO: 2076
  Description of Artificial Sequence: Synthetic oligonucleotide

SEQ ID NO: 2078 - DNA, 100 bp, Artificial Sequence
  Description of Artificial Sequence: Synthetic polynucleotide
gctgctgctgctgctgctggcgctgtgcggctgcccggcccccgccgcggcctcgccgctcctgctatttgccaaccgccgggacgtacggctggtggac

SEQ ID NO: 2079 - DNA, 50 bp, Artificial Sequence
  Description of Artificial Sequence: Synthetic oligonucleotide
gcccggcccccgccgcggcctcgccgctcctgctatttgccaacccccgg

SEQ ID NO: 2080 - DNA, 50 bp, Artificial Sequence; identical to SEQ ID NO: 2079
  Description of Artificial Sequence: Synthetic oligonucleotide

SEQ ID NO: 2081 - DNA, 100 bp, Artificial Sequence
  Description of Artificial Sequence: Synthetic polynucleotide
tctccgcggtccggcccggggccccgggatctcggctgtccttcctcccggattctttctactaatccagatacttgttgaagtgctgactagtttcttg

SEQ ID NO: 2082 - DNA, 50 bp, Artificial Sequence
  Description of Artificial Sequence: Synthetic oligonucleotide
ggcccggggccccgggatctcggctgtccttcctcccggattctttctac

SEQ ID NO: 2083 - DNA, 50 bp, Artificial Sequence; identical to SEQ ID NO: 2082
  Description of Artificial Sequence: Synthetic oligonucleotide

SEQ ID NO: 2084 - DNA, 50 bp, Artificial Sequence; identical to SEQ ID NO: 2082
  Description of Artificial Sequence: Synthetic oligonucleotide

SEQ ID NO: 2085 - DNA, 50 bp, Artificial Sequence
  Description of Artificial Sequence: Synthetic oligonucleotide
ccggggccccgggatctcggctgtccttcctcccggattctttctactaa

SEQ ID NO: 2086 - DNA, 49 bp, Artificial Sequence
  Description of Artificial Sequence: Synthetic oligonucleotide
ggggccccgggatctcggctgtccttcctcccggattctttctactaat

SEQ ID NO: 2087 - DNA, 50 bp, Artificial Sequence
  Description of Artificial Sequence: Synthetic oligonucleotide
ggggccccgggatctcggctgtccttcctcccggattctttctactaatc

SEQ ID NO: 2088 - DNA, 50 bp, Artificial Sequence; identical to SEQ ID NO: 2087
  Description of Artificial Sequence: Synthetic oligonucleotide

SEQ ID NO: 2089 - DNA, 50 bp, Artificial Sequence
  Description of Artificial Sequence: Synthetic oligonucleotide
cggctgtccttcctcccggattctttctactaatccagatacttgttgaa

SEQ ID NO: 2090 - DNA, 50 bp, Artificial Sequence
  Description of Artificial Sequence: Synthetic oligonucleotide
cggctgtccttcctcccggattctttctactaatcctgatacttgttgaa

SEQ ID NO: 2091 - DNA, 50 bp, Artificial Sequence
  Description of Artificial Sequence: Synthetic oligonucleotide
cggctgtccttcctcccggattctttctactaatctagatacttgttgaa

SEQ ID NO: 2092 - DNA, 50 bp, Artificial Sequence; identical to SEQ ID NO: 2089
  Description of Artificial Sequence: Synthetic oligonucleotide

SEQ ID NO: 2093 - DNA, 50 bp, Artificial Sequence; identical to SEQ ID NO: 2089
  Description of Artificial Sequence: Synthetic oligonucleotide

SEQ ID NO: 2094 - DNA, 50 bp, Artificial Sequence; identical to SEQ ID NO: 2089
  Description of Artificial Sequence: Synthetic oligonucleotide

SEQ ID NO: 2095 - DNA, 50 bp, Artificial Sequence; identical to SEQ ID NO: 2090
  Description of Artificial Sequence: Synthetic oligonucleotide

SEQ ID NO: 2096 - DNA, 50 bp, Artificial Sequence; identical to SEQ ID NO: 2089
  Description of Artificial Sequence: Synthetic oligonucleotide

SEQ ID NO: 2097 - DNA, 50 bp, Artificial Sequence; identical to SEQ ID NO: 2089
  Description of Artificial Sequence: Synthetic oligonucleotide

SEQ ID NO: 2098 - DNA, 50 bp, Artificial Sequence; identical to SEQ ID NO: 2089
  Description of Artificial Sequence: Synthetic oligonucleotide

SEQ ID NO: 2099 - DNA, 50 bp, Artificial Sequence; identical to SEQ ID NO: 2089
  Description of Artificial Sequence: Synthetic oligonucleotide

SEQ ID NO: 2100 - DNA, 50 bp, Artificial Sequence; identical to SEQ ID NO: 2089
  Description of Artificial Sequence: Synthetic oligonucleotide

SEQ ID NO: 2101 - DNA, 50 bp, Artificial Sequence; identical to SEQ ID NO: 2089
  Description of Artificial Sequence: Synthetic oligonucleotide

SEQ ID NO: 2102 - DNA, 50 bp, Artificial Sequence
  Description of Artificial Sequence: Synthetic oligonucleotide
cggctgtccttcctcccggattctttctattaatccagatacttgttgaa

SEQ ID NO: 2103 - DNA, 50 bp, Artificial Sequence; identical to SEQ ID NO: 2089
  Description of Artificial Sequence: Synthetic oligonucleotide

SEQ ID NO: 2104 - DNA, 50 bp, Artificial Sequence; identical to SEQ ID NO: 2089
  Description of Artificial Sequence: Synthetic oligonucleotide

SEQ ID NO: 2105 - DNA, 50 bp, Artificial Sequence; identical to SEQ ID NO: 2089
  Description of Artificial Sequence: Synthetic oligonucleotide

SEQ ID NO: 2106 - DNA, 50 bp, Artificial Sequence
  Description of Artificial Sequence: Synthetic oligonucleotide
cggctgtccttcctcccggattctttttactaatccagatacttgttgaa

SEQ ID NO: 2107 - DNA, 50 bp, Artificial Sequence; identical to SEQ ID NO: 2089
  Description of Artificial Sequence: Synthetic oligonucleotide

SEQ ID NO: 2108 - DNA, 50 bp, Artificial Sequence; identical to SEQ ID NO: 2106
  Description of Artificial Sequence: Synthetic oligonucleotide

SEQ ID NO: 2109 - DNA, 100 bp, Artificial Sequence
  Description of Artificial Sequence: Synthetic polynucleotide
gctgctgctgctgctgctggcgctgtgcggctgcccggcccccgccgcgggtaggtgggcgcaggccggccgggggccgcgggttgctcggacaatggcc

SEQ ID NO: 2110 - DNA, 100 bp, Artificial Sequence
  Description of Artificial Sequence: Synthetic polynucleotide
aatgtctagaattttgaaagatgaaagattcacttttactttcattgcaggattctttctactaatccagatacttgttgaagtgctgactagtttcttg

SEQ ID NO: 2111 - DNA, 100 bp, Artificial Sequence
  Description of Artificial Sequence: Synthetic polynucleotide
ctgccccacgggtgtgcagctgcaggacaacggcaggacgtgtaaggcagcttgtgagatccaccatgaagaaggagttggatgcagtccgaattaaaac

SEQ ID NO: 2112 - DNA, 50 bp, Artificial Sequence
  Description of Artificial Sequence: Synthetic oligonucleotide
gcaggacaacggcaggacgtgtaaggcagcttgtgagatccaccatgaag

SEQ ID NO: 2113 - DNA, 50 bp, Artificial Sequence; identical to SEQ ID NO: 2112
  Description of Artificial Sequence: Synthetic oligonucleotide

SEQ ID NO: 2114 - DNA, 100 bp, Artificial Sequence
  Description of Artificial Sequence: Synthetic polynucleotide
ctgccccacgggtgtgcagctgcaggacaacggcaggacgtgtaaggcaggagccgaggaggtgctgctgctggcccggcggacggacctacggaggatc

SEQ ID NO: 2115 - DNA, 50 bp, Artificial Sequence
  Description of Artificial Sequence: Synthetic oligonucleotide
gcaggacaacggcaggacgtgtaaggcaggagccgaggaggggctgctgc

SEQ ID NO: 2116 - DNA, 50 bp, Artificial Sequence; identical to SEQ ID NO: 2115
  Description of Artificial Sequence: Synthetic oligonucleotide

SEQ ID NO: 2117 - DNA, 50 bp, Artificial Sequence; identical to SEQ ID NO: 2115
  Description of Artificial Sequence: Synthetic oligonucleotide

SEQ ID NO: 2118 - DNA, 100 bp, Artificial Sequence
  Description of Artificial Sequence: Synthetic polynucleotide
ttgcacacataaatggaaaaaagaatactgaagagacactgaccactgagcttgtgagatccaccatgaagaaggagttggatgcagtccgaattaaaac

SEQ ID NO: 2119 - DNA, 100 bp, Artificial Sequence
  Description of Artificial Sequence: Synthetic polynucleotide
ctgccccacgggtgtgcagctgcaggacaacggcaggacgtgtaaggcaggtgaggcggtgggacgggacggggcgggcgggcggggcggggcctggcgg

SEQ ID NO: 2120 - DNA, 100 bp, Artificial Sequence
  Description of Artificial Sequence: Synthetic polynucleotide
acacattattgacatctcacaaatgcttgttgttatttttgttgctgaagcttgtgagatccaccatgaagaaggagttggatgcagtccgaattaaaac

SEQ ID NO: 2121 - DNA, 100 bp, Artificial Sequence
  Description of Artificial Sequence: Synthetic polynucleotide
aagcagctggtggctggtgacatcgtcctggacaagctaggggaaaggctgctctcagaaaaagagaagaaacaaatatctgagcaattgaatgccctaa

SEQ ID NO: 2122 - DNA, 50 bp, Artificial Sequence
  Description of Artificial Sequence: Synthetic oligonucleotide
ggtgacatcgtcctggacaagctaggggaaaggctgctctcagaaaaaga

SEQ ID NO: 2123 - DNA, 50 bp, Artificial Sequence
  Description of Artificial Sequence: Synthetic oligonucleotide
ggacaagctaggggaaaggctgctctcagaaaaagagaagaaacaaatat

SEQ ID NO: 2124 - DNA, 50 bp, Artificial Sequence; identical to SEQ ID NO: 2123
  Description of Artificial Sequence: Synthetic oligonucleotide

SEQ ID NO: 2125 - DNA, 100 bp, Artificial Sequence
  Description of Artificial Sequence: Synthetic polynucleotide
aagcagctggtggctggtgacatcgtcctggacaagctaggggaaaggctagccatcctcctcaaggtgcgagacatggtcagcagccatgtggagcgag

SEQ ID NO: 2126 - DNA, 100 bp, Artificial Sequence
  Description of Artificial Sequence: Synthetic polynucleotide
tctgaagctattaaaacatcacagatcttcttggccaagcatggtcataagctctcagaaaaagagaagaaacaaatatctgagcaattgaatgccctaa

SEQ ID NO: 2127 - DNA, 100 bp, Artificial Sequence
  Description of Artificial Sequence: Synthetic polynucleotide
aagcagctggtggctggtgacatcgtcctggacaagctaggggaaaggctgtaagcagctccctagtgctgtttcttggtggaaggattttaaaacgagg

SEQ ID NO: 2128 - DNA, 50 bp, Artificial Sequence
  Description of Artificial Sequence: Synthetic oligonucleotide
ggctggtgacatcgtcctggacaagctaggggaaaggctgtaagcagctc

SEQ ID NO: 2129 - DNA, 100 bp, Artificial Sequence
  Description of Artificial Sequence: Synthetic polynucleotide
ggagattgtttttttttctcctaaaaaagctttaatgcttcatcttccaggctctcagaaaaagagaagaaacaaatatctgagcaattgaatgccctaa

SEQ ID NO: 2130 - DNA, 100 bp, Artificial Sequence
  Description of Artificial Sequence: Synthetic polynucleotide
gcgatggcatcggtcaaggtggccgtgagggtccggcccatgaatcgcagcttccctttgctgaaggtctgtaccacttttatcacaatggccttgcaaa

SEQ ID NO: 2131 - DNA, 50 bp, Artificial Sequence
  Description of Artificial Sequence: Synthetic oligonucleotide
ccggcccatgaatcgcagcttccctttgctgaaggtctgtaccactttta

SEQ ID NO: 2132 - DNA, 100 bp, Artificial Sequence
  Description of Artificial Sequence: Synthetic polynucleotide
gcgatggcatcggtcaaggtggccgtgagggtccggcccatgaatcgcagggaaaaggacttggaggccaagttcattattcagatggagaaaagcaaaa

SEQ ID NO: 2133 - DNA, 50 bp, Artificial Sequence
  Description of Artificial Sequence: Synthetic oligonucleotide
gtgagggtccggcccatgaatcgcagggaaaaggacttggaggccaagtt

SEQ ID NO: 2134 - DNA, 50 bp, Artificial Sequence
  Description of Artificial Sequence: Synthetic oligonucleotide
ggcccatgaatcgcagggaaaaggacttggaggccaagttcattattcag

SEQ ID NO: 2135 - DNA, 100 bp, Artificial Sequence
  Description of Artificial Sequence: Synthetic polynucleotide
aggacaaagctcgccaagttgcagcagaacacggctttggagtccgaaagcttccctttgctgaaggtctgtaccacttttatcacaatggccttgcaaa

SEQ ID NO: 2136 - DNA, 100 bp, Artificial Sequence
  Description of Artificial Sequence: Synthetic polynucleotide
gcgatggcatcggtcaaggtggccgtgagggtccggcccatgaatcgcaggtgagtggggccgcccgcgccccgccccctcgtcgcgcccccacccagag

SEQ ID NO: 2137 - DNA, 100 bp, Artificial Sequence
  Description of Artificial Sequence: Synthetic polynucleotide
gggccaaccccagaagctaactatgcctatgtctacttgactctccacagcttccctttgctgaaggtctgtaccacttttatcacaatggccttgcaaa

SEQ ID NO: 2138 - DNA, 100 bp, Artificial Sequence
  Description of Artificial Sequence: Synthetic polynucleotide
gtaccccagaggagaagctggctgctctgtgcaagaagtatgctgaactggtaccttgtgggtcaacgactcgtgaactacgaacggaaatctggcaaac

SEQ ID NO: 2139 - DNA, 50 bp, Artificial Sequence
  Description of Artificial Sequence: Synthetic oligonucleotide
ggctgctctgtgcaagaagtatgctgaactggtaccttgtgggtcaacga

SEQ ID NO: 2140 - DNA, 50 bp, Artificial Sequence; identical to SEQ ID NO: 2139
  Description of Artificial Sequence: Synthetic oligonucleotide

SEQ ID NO: 2141 - DNA, 50 bp, Artificial Sequence
  Description of Artificial Sequence: Synthetic oligonucleotide
ctgtgcaagaagtacgctgaactggtaccttgtgggtcaacgactcgtga

SEQ ID NO: 2142 - DNA, 50 bp, Artificial Sequence; identical to SEQ ID NO: 2141
  Description of Artificial Sequence: Synthetic oligonucleotide

SEQ ID NO: 2143 - DNA, 100 bp, Artificial Sequence
  Description of Artificial Sequence: Synthetic polynucleotide
gtaccccagaggagaagctggctgctctgtgcaagaagtatgctgaactgctggaggagcaccggaattcacagaagcagatgaagctcctacagaaaaa

SEQ ID NO: 2144 - DNA, 50 bp, Artificial Sequence
  Description of Artificial Sequence: Synthetic oligonucleotide
ggctgctctgtgcaagaagtatgctgaactgctggaggagcaccggaatt

SEQ ID NO: 2145 - DNA, 50 bp, Artificial Sequence; identical to SEQ ID NO: 2144
  Description of Artificial Sequence: Synthetic oligonucleotide

SEQ ID NO: 2146 - DNA, 50 bp, Artificial Sequence
  Description of Artificial Sequence: Synthetic oligonucleotide
ctgtgcaagaagtatgctgaactgctggaggagcaccggaattcacagaa

SEQ ID NO: 2147 - DNA, 50 bp, Artificial Sequence
  Description of Artificial Sequence: Synthetic oligonucleotide
gtgcaagaagtatgctgaactgctggaggagcactggaattcacagaagc

SEQ ID NO: 2148 - DNA, 50 bp, Artificial Sequence
  Description of Artificial Sequence: Synthetic oligonucleotide
gtgcaagaagtatgttgaactgctggaggagcaccggaattcacagaagc

SEQ ID NO: 2149 - DNA, 50 bp, Artificial Sequence; identical to SEQ ID NO: 2147
  Description of Artificial Sequence: Synthetic oligonucleotide

SEQ ID NO: 2150 - DNA, 50 bp, Artificial Sequence; identical to SEQ ID NO: 2147
  Description of Artificial Sequence: Synthetic oligonucleotide

SEQ ID NO: 2151 - DNA, 50 bp, Artificial Sequence; identical to SEQ ID NO: 2148
  Description of Artificial Sequence: Synthetic oligonucleotide

SEQ ID NO: 2152 - DNA, 50 bp, Artificial Sequence; identical to SEQ ID NO: 2148
  Description of Artificial Sequence: Synthetic oligonucleotide

SEQ ID NO: 2153 - DNA, 50 bp, Artificial Sequence; identical to SEQ ID NO: 2148
  Description of Artificial Sequence: Synthetic oligonucleotide

SEQ ID NO: 2154 - DNA, 50 bp, Artificial Sequence
  Description of Artificial Sequence: Synthetic oligonucleotide
  modified_base (1)..(1): a, c, t, g, unknown or other
ntgcaagaagtatgctgaactgctggaggagcactggaattcacagaagc

SEQ ID NO: 2155 - DNA, 100 bp, Artificial Sequence
  Description of Artificial Sequence: Synthetic polynucleotide
ttccaagtccgccagtttaagcgcctttatgaacatattaaaaatgacaagtaccttgtgggtcaacgactcgtgaactacgaacggaaatctggcaaac

SEQ ID NO: 2156 - DNA, 100 bp, Artificial Sequence
  Description of Artificial Sequence: Synthetic polynucleotide
gtaccccagaggagaagctggctgctctgtgcaagaagtatgctgaactggtcagttcccccctccgcgggcaccttccctgcgttgggaaaatcagcat

SEQ ID NO: 2157 - DNA, 50 bp, Artificial Sequence
  Description of Artificial Sequence: Synthetic oligonucleotide
gtgcaagaagtatgctgaactggtcagttcccccctccgcgggcaccttc

SEQ ID NO: 2158 - DNA, 50 bp, Artificial Sequence; identical to SEQ ID NO: 2157
  Description of Artificial Sequence: Synthetic oligonucleotide

SEQ ID NO: 2159 - DNA, 50 bp, Artificial Sequence; identical to SEQ ID NO: 2157
  Description of Artificial Sequence: Synthetic oligonucleotide

SEQ ID NO: 2160 - DNA, 50 bp, Artificial Sequence; identical to SEQ ID NO: 2157
  Description of Artificial Sequence: Synthetic oligonucleotide

SEQ ID NO: 2161 - DNA, 100 bp, Artificial Sequence
  Description of Artificial Sequence: Synthetic polynucleotide
tactctgtacattcatagaagagagtaaccaccttgtttttgcaacctaggtaccttgtgggtcaacgactcgtgaactacgaacggaaatctggcaaac

SEQ ID NO: 2162 - DNA, 100 bp, Artificial Sequence
  Description of Artificial Sequence: Synthetic polynucleotide
atgatcaaggtcagctggtccacatgaacaggcttccaggaggaaatgagatggtcacaagaacaaagaaaatatttgtaggcgggttatctgcgaacac

SEQ ID NO: 2163 - DNA, 50 bp, Artificial Sequence
  Description of Artificial Sequence: Synthetic oligonucleotide
cagctggtccacatgaacaggcttccaggaggaaatgagatggtcacaag

SEQ ID NO: 2164 - DNA, 50 bp, Artificial Sequence; identical to SEQ ID NO: 2163
  Description of Artificial Sequence: Synthetic oligonucleotide

SEQ ID NO: 2165 - DNA, 50 bp, Artificial Sequence; identical to SEQ ID NO: 2163
  Description of Artificial Sequence: Synthetic oligonucleotide

SEQ ID NO: 2166 - DNA, 50 bp, Artificial Sequence; identical to SEQ ID NO: 2163
  Description of Artificial Sequence: Synthetic oligonucleotide

SEQ ID NO: 2167 - DNA, 50 bp, Artificial Sequence; identical to SEQ ID NO: 2163
  Description of Artificial Sequence: Synthetic oligonucleotide

SEQ ID NO: 2168 - DNA, 50 bp, Artificial Sequence; identical to SEQ ID NO: 2163
  Description of Artificial Sequence: Synthetic oligonucleotide

SEQ ID NO: 2169 - DNA, 50 bp, Artificial Sequence
  Description of Artificial Sequence: Synthetic oligonucleotide
ggtccacatgaacaggcttccaggaggaaatgagatggtcacaagaacaa

SEQ ID NO: 2170 - DNA, 50 bp, Artificial Sequence; identical to SEQ ID NO: 2169
  Description of Artificial Sequence: Synthetic oligonucleotide

SEQ ID NO: 2171 - DNA, 50 bp, Artificial Sequence
  Description of Artificial Sequence: Synthetic oligonucleotide
tccaggaggaaatgagatggtcacaagaacaaagaaaatatttgtaggcg

SEQ ID NO: 2172 - DNA, 100 bp, Artificial Sequence
  Description of Artificial Sequence: Synthetic polynucleotide
atgatcaaggtcagctggtccacatgaacaggcttccaggaggaaatgagattggcatggtagcttggaaaatgacctttaaaagtcctgaatatccaga

SEQ ID NO: 2173 - DNA, 50 bp, Artificial Sequence
  Description of Artificial Sequence: Synthetic oligonucleotide
ggtccacatgaacaggcttccaggaggaaatgagattggcatggtagctt

SEQ ID NO: 2174 - DNA, 50 bp, Artificial Sequence; identical to SEQ ID NO: 2173
  Description of Artificial Sequence: Synthetic oligonucleotide

SEQ ID NO: 2175 - DNA, 50 bp, Artificial Sequence; identical to SEQ ID NO: 2173
  Description of Artificial Sequence: Synthetic oligonucleotide

SEQ ID NO: 2176 - DNA, 50 bp, Artificial Sequence
  Description of Artificial Sequence: Synthetic oligonucleotide
ccacatgaacagccttccaggaggaaatgagattggcatggtagcttgga

SEQ ID NO: 2177 - DNA, 50 bp, Artificial Sequence; identical to SEQ ID NO: 2176
  Description of Artificial Sequence: Synthetic oligonucleotide

SEQ ID NO: 2178 - DNA, 49 bp, Artificial Sequence
  Description of Artificial Sequence: Synthetic oligonucleotide
acaggcttccaggaggaaatgagattggcatggtagcttggaaaatgac

SEQ ID NO: 2179 - DNA, 49 bp, Artificial Sequence; identical to SEQ ID NO: 2178
  Description of Artificial Sequence: Synthetic oligonucleotide

SEQ ID NO: 2180 - DNA, 49 bp, Artificial Sequence; identical to SEQ ID NO: 2178
  Description of Artificial Sequence: Synthetic oligonucleotide

SEQ ID NO: 2181 - DNA, 49 bp, Artificial Sequence; identical to SEQ ID NO: 2178
  Description of Artificial Sequence: Synthetic oligonucleotide

SEQ ID NO: 2182 - DNA, 49 bp, Artificial Sequence; identical to SEQ ID NO: 2178
  Description of Artificial Sequence: Synthetic oligonucleotide

SEQ ID NO: 2183 - DNA, 49 bp, Artificial Sequence; identical to SEQ ID NO: 2178
  Description of Artificial Sequence: Synthetic oligonucleotide

SEQ ID NO: 2184 - DNA, 49 bp, Artificial Sequence
  Description of Artificial Sequence: Synthetic oligonucleotide
caggcttccaggaggaaatgagattggcatggtagcttggaaaatgacc

SEQ ID NO: 2185 - DNA, 50 bp, Artificial Sequence
  Description of Artificial Sequence: Synthetic oligonucleotide
tccaggaggaaatgagattggcatggtagcttggaaaatgacctttaaaa

SEQ ID NO: 2186 - DNA, 50 bp, Artificial Sequence
  Description of Artificial Sequence: Synthetic oligonucleotide
aggaggaaatgagattggcatggtagcttggaaaatgacctttaaaagtc

SEQ ID NO: 2187 - DNA, 50 bp, Artificial Sequence; identical to SEQ ID NO: 2186
  Description of Artificial Sequence: Synthetic oligonucleotide

SEQ ID NO: 2188 - DNA, 50 bp, Artificial Sequence; identical to SEQ ID NO: 2186
  Description of Artificial Sequence: Synthetic oligonucleotide

SEQ ID NO: 2189 - DNA, 48 bp, Artificial Sequence
  Description of Artificial Sequence: Synthetic oligonucleotide
aggaggaaatgagattggcatggtagcttggaaaatgacctttaaaag

SEQ ID NO: 2190 - DNA, 50 bp, Artificial Sequence; identical to SEQ ID NO: 2186
  Description of Artificial Sequence: Synthetic oligonucleotide

SEQ ID NO: 2191 - DNA, 50 bp, Artificial Sequence; identical to SEQ ID NO: 2186
  Description of Artificial Sequence: Synthetic oligonucleotide

SEQ ID NO: 2192 - DNA, 50 bp, Artificial Sequence; identical to SEQ ID NO: 2186
  Description of Artificial Sequence: Synthetic oligonucleotide

SEQ ID NO: 2193 - DNA, 49 bp, Artificial Sequence
  Description of Artificial Sequence: Synthetic oligonucleotide
aggaggaaatgagattggcatggtagcttggaaaatgacctttaaaagt

SEQ ID NO: 2194 - DNA, 50 bp, Artificial Sequence; identical to SEQ ID NO: 2186
  Description of Artificial Sequence: Synthetic oligonucleotide

SEQ ID NO: 2195 - DNA, 100 bp, Artificial Sequence
  Description of Artificial Sequence: Synthetic polynucleotide
ccaagacgattgaccccaaagttgcatttcctcgtcgagcgcaacccaagatggtcacaagaacaaagaaaatatttgtaggcgggttatctgcgaacac

SEQ ID NO: 2196 - DNA, 100 bp, Artificial Sequence
  Description of Artificial Sequence: Synthetic polynucleotide
atgatcaaggtcagctggtccacatgaacaggcttccaggaggaaatgaggcaagtagttgaaaccccccttccctttcttatctctgtgcccactagta

SEQ ID NO: 2197 - DNA, 50 bp, Artificial Sequence
  Description of Artificial Sequence: Synthetic oligonucleotide
acatgaacaggcttccaggaggaaatgaggcaagtagttgaaacccccct

SEQ ID NO: 2198 - DNA, 50 bp, Artificial Sequence; identical to SEQ ID NO: 2197
  Description of Artificial Sequence: Synthetic oligonucleotide

SEQ ID NO: 2199 - DNA, 50 bp, Artificial Sequence; identical to SEQ ID NO: 2197
  Description of Artificial Sequence: Synthetic oligonucleotide

SEQ ID NO: 2200 - DNA, 48 bp, Artificial Sequence
  Description of Artificial Sequence: Synthetic oligonucleotide
acatgaacaggcttccaggaggaaatgaggcaagtagttgaaaccccc

SEQ ID NO: 2201 - DNA, 50 bp, Artificial Sequence
  Description of Artificial Sequence: Synthetic oligonucleotide
atgaggcaagtagttgaaaccccccttccctttcttatctctgtgcccac

SEQ ID NO: 2202 - DNA, 50 bp, Artificial Sequence; identical to SEQ ID NO: 2201
  Description of Artificial Sequence: Synthetic oligonucleotide

SEQ ID NO: 2203 - DNA, 50 bp, Artificial Sequence; identical to SEQ ID NO: 2201
  Description of Artificial Sequence: Synthetic oligonucleotide

SEQ ID NO: 2204 - DNA, 100 bp, Artificial Sequence
  Description of Artificial Sequence: Synthetic polynucleotide
gctttagataacctggttaacccatgcctttctcttgtcatttcttgcagatggtcacaagaacaaagaaaatatttgtaggcgggttatctgcgaacac

SEQ ID NO: 2205 - DNA, 100 bp, Artificial Sequence
  Description of Artificial Sequence: Synthetic polynucleotide
cactgtaacggtgccaactccaatttaccaaactagcagtggacagtatacattcgttcagtcagagagcataatagaagtactgcgttttgatgatgga

SEQ ID NO: 2206 - DNA, 50 bp, Artificial Sequence
  Description of Artificial Sequence: Synthetic oligonucleotide
agcagtggacagtatacattcgttcagtcagagagcataatagaagtact

SEQ ID NO: 2207 - DNA, 50 bp, Artificial Sequence; identical to SEQ ID NO: 2206
  Description of Artificial Sequence: Synthetic oligonucleotide

SEQ ID NO: 2208 - DNA, 50 bp, Artificial Sequence; identical to SEQ ID NO: 2206
  Description of Artificial Sequence: Synthetic oligonucleotide

SEQ ID NO: 2209 - DNA, 50 bp, Artificial Sequence; identical to SEQ ID NO: 2206
  Description of Artificial Sequence: Synthetic oligonucleotide

SEQ ID NO: 2210 - DNA, 50 bp, Artificial Sequence; identical to SEQ ID NO: 2206
  Description of Artificial Sequence: Synthetic oligonucleotide

SEQ ID NO: 2211 - DNA, 50 bp, Artificial Sequence; identical to SEQ ID NO: 2206
  Description of Artificial Sequence: Synthetic oligonucleotide

SEQ ID NO: 2212 - DNA, 50 bp, Artificial Sequence; identical to SEQ ID NO: 2206
  Description of Artificial Sequence: Synthetic oligonucleotide

SEQ ID NO: 2213 - DNA, 50 bp, Artificial Sequence; identical to SEQ ID NO: 2206
  Description of Artificial Sequence: Synthetic oligonucleotide

SEQ ID NO: 2214 - DNA, 50 bp, Artificial Sequence; identical to SEQ ID NO: 2206
  Description of Artificial Sequence: Synthetic oligonucleotide

SEQ ID NO: 2215 - DNA, 50 bp, Artificial Sequence; identical to SEQ ID NO: 2206
  Description of Artificial Sequence: Synthetic oligonucleotide

SEQ ID NO: 2216 - DNA, 50 bp, Artificial Sequence; identical to SEQ ID NO: 2206
  Description of Artificial Sequence: Synthetic oligonucleotide

SEQ ID NO: 2217 - DNA, 50 bp, Artificial Sequence; identical to SEQ ID NO: 2206
  Description of Artificial Sequence: Synthetic oligonucleotide

SEQ ID NO: 2218 - DNA, 50 bp, Artificial Sequence; identical to SEQ ID NO: 2206
  Description of Artificial Sequence: Synthetic oligonucleotide

SEQ ID NO: 2219 - DNA, 50 bp, Artificial Sequence; identical to SEQ ID NO: 2206
  Description of Artificial Sequence: Synthetic oligonucleotide

SEQ ID NO: 2220 - DNA, 50 bp, Artificial Sequence
  Description of Artificial Sequence: Synthetic oligonucleotide
agcagtggacggtatacattcgttcagtcagagagcataatagaagtact

SEQ ID NO: 2221 - DNA, 50 bp, Artificial Sequence
  Description of Artificial Sequence: Synthetic oligonucleotide
agcagtggacagtatacattcgttcagtcagagagcataatagaagaact

SEQ ID NO: 2222 - DNA, 100 bp, Artificial Sequence
  Description of Artificial Sequence: Synthetic polynucleotide
cactgtaacggtgccaactccaatttaccaaactagcagtggacagtatattgccattacccagggaggagcaatacagctggctaacaatggtaccgat

SEQ ID NO: 2223 - DNA, 100 bp, Artificial Sequence
  Description of Artificial Sequence: Synthetic polynucleotide
gcacctggtgatgaccctcgtagtggctgcggcgcgggccgagaaggaagcattcgttcagtcagagagcataatagaagtactgcgttttgatgatgga

SEQ ID NO: 2224 - DNA, 50 bp, Artificial Sequence
  Description of Artificial Sequence: Synthetic oligonucleotide
ggtgatgaccctcgtagtggctgcggcgcgggccgggaaggaagcattcg

SEQ ID NO: 2225 - DNA, 50 bp, Artificial Sequence
  Description of Artificial Sequence: Synthetic oligonucleotide
ggtgatgaccctcgtagtggctggggcgcgggccgagaaggaagcattcg

SEQ ID NO: 2226 - DNA, 50 bp, Artificial Sequence; identical to SEQ ID NO: 2225
  Description of Artificial Sequence: Synthetic oligonucleotide

SEQ ID NO: 2227 - DNA, 49 bp, Artificial Sequence
  Description of Artificial Sequence: Synthetic oligonucleotide
gtggctgcggcgcgggccgagaaggaagcattcgttcagtcagagagca

SEQ ID NO: 2228 - DNA, 49 bp, Artificial Sequence; identical to SEQ ID NO: 2227
  Description of Artificial Sequence: Synthetic oligonucleotide

SEQ ID NO: 2229 - DNA, 49 bp, Artificial Sequence; identical to SEQ ID NO: 2227
  Description of Artificial Sequence: Synthetic oligonucleotide

SEQ ID NO: 2230 - DNA, 50 bp, Artificial Sequence
  Description of Artificial Sequence: Synthetic oligonucleotide
ggcgcgggccgagaaggaagcattcgttcagtcagagagcatagtagaag

SEQ ID NO: 2231 - DNA, 50 bp, Artificial Sequence
  Description of Artificial Sequence: Synthetic oligonucleotide
ggcgcgggccgagaaggaagcattcgttcagtcagagagcataatagaag

SEQ ID NO: 2232 - DNA, 50 bp, Artificial Sequence; identical to SEQ ID NO: 2231
  Description of Artificial Sequence: Synthetic oligonucleotide

SEQ ID NO: 2233 - DNA, 50 bp, Artificial Sequence
  Description of Artificial Sequence: Synthetic oligonucleotide
cgggccgagaaggaagcattcgttcagtcagagagcataatagaagtact

SEQ ID NO: 2234 - DNA, 50 bp, Artificial Sequence; identical to SEQ ID NO: 2233
  Description of Artificial Sequence: Synthetic oligonucleotide

SEQ ID NO: 2235 - DNA, 50 bp, Artificial Sequence; identical to SEQ ID NO: 2233
  Description of Artificial Sequence: Synthetic oligonucleotide

SEQ ID NO: 2236 - DNA, 50 bp, Artificial Sequence; identical to SEQ ID NO: 2233
  Description of Artificial Sequence: Synthetic oligonucleotide

SEQ ID NO: 2237 - DNA, 50 bp, Artificial Sequence; identical to SEQ ID NO: 2233
  Description of Artificial Sequence: Synthetic oligonucleotide

SEQ ID NO: 2238 - DNA, 50 bp, Artificial Sequence
  Description of Artificial Sequence: Synthetic oligonucleotide
gagaaggaagcattcgttcagtcagagagtataatagaagtactgcgttt

SEQ ID NO: 2239 - DNA, 100 bp, Artificial Sequence
  Description of Artificial Sequence: Synthetic polynucleotide
cactgtaacggtgccaactccaatttaccaaactagcagtggacagtatagtgagtaatagacaatttctgtttctattgtgaggagaaaaaagtgagga

SEQ ID NO: 2240 - DNA, 50 bp, Artificial Sequence
  Description of Artificial Sequence: Synthetic oligonucleotide
agcagtggacagtatagtgagtaatagacaatttctgtttctattgtgag

SEQ ID NO: 2241 - DNA, 50 bp, Artificial Sequence
  Description of Artificial Sequence: Synthetic oligonucleotide
agcagtggacagtatagtgagtaatagacaatttctgtttttattgtgag

SEQ ID NO: 2242 - DNA, 50 bp, Artificial Sequence
  Description of Artificial Sequence: Synthetic oligonucleotide
tggacagtatagtgagtaatagacaatttctgtttctattgtgaggagaa

SEQ ID NO: 2243 - DNA, 50 bp, Artificial Sequence
  Description of Artificial Sequence: Synthetic oligonucleotide
ggacagtatagtgagtaatagacaatttctgtttctattgtgaggagaaa

SEQ ID NO: 2244 - DNA, 50 bp, Artificial Sequence; identical to SEQ ID NO: 2243
  Description of Artificial Sequence: Synthetic oligonucleotide

SEQ ID NO: 2245 - DNA, 48 bp, Artificial Sequence
  Description of Artificial Sequence: Synthetic oligonucleotide
acagtatagtgagtaatagacaatttctgtttctattgtgaggagaaa

SEQ ID NO: 2246 - DNA, 100 bp, Artificial Sequence
  Description of Artificial Sequence: Synthetic polynucleotide
aatcaaatttatgttcctgtaagtgatggtatgttttgttttcttcacagcattcgttcagtcagagagcataatagaagtactgcgttttgatgatgga

SEQ ID NO: 2247 - DNA, 100 bp, Artificial Sequence
  Description of Artificial Sequence: Synthetic polynucleotide
tgcactgagcgggacctgcgagcagcgcgggcggcagcccgggggaagcgtatctacatgaaaatgggattgtccatcgtgatctcaaaccagagaatct

SEQ ID NO: 2248 - DNA, 50 bp, Artificial Sequence
  Description of Artificial Sequence: Synthetic oligonucleotide
gcggcagcccgggggaagcgtatctacatgaaaatgggattgtccatcgt

SEQ ID NO: 2249 - DNA, 50 bp, Artificial Sequence; identical to SEQ ID NO: 2248
  Description of Artificial Sequence: Synthetic oligonucleotide

SEQ ID NO: 2250 - DNA, 50 bp, Artificial Sequence; identical to SEQ ID NO: 2248
  Description of Artificial Sequence: Synthetic oligonucleotide

SEQ ID NO: 2251 - DNA, 50 bp, Artificial Sequence; identical to SEQ ID NO: 2248
  Description of Artificial Sequence: Synthetic oligonucleotide

SEQ ID NO: 2252 - DNA, 50 bp, Artificial Sequence; identical to SEQ ID NO: 2248
  Description of Artificial Sequence: Synthetic oligonucleotide

SEQ ID NO: 2253 - DNA, 100 bp, Artificial Sequence
  Description of Artificial Sequence: Synthetic polynucleotide
tgcactgagcgggacctgcgagcagcgcgggcggcagcccgggggaagcgtccgggaccatgtctggagaactaccaccaaacattaacatcaaggaacc

SEQ ID NO: 2254 - DNA, 100 bp, Artificial Sequence
  Description of Artificial Sequence: Synthetic polynucleotide
gtgagcgagatgctgcagatgccgttaaacaaatcctggaggcagttgcttatctacatgaaaatgggattgtccatcgtgatctcaaaccagagaatct

SEQ ID NO: 2255 - DNA, 100 bp, Artificial Sequence
  Description of Artificial Sequence: Synthetic polynucleotide
tgcactgagcgggacctgcgagcagcgcgggcggcagcccgggggaagcggtgagtcgcgggcggcaggcccagccaggtgggtggggaaacgcgcaggg

SEQ ID NO: 2256 - DNA, 100 bp, Artificial Sequence
  Description of Artificial Sequence: Synthetic polynucleotide
aaccataaatagcattacacaaatgttatttcattattttccctctttagtatctacatgaaaatgggattgtccatcgtgatctcaaaccagagaatct

SEQ ID NO: 2257 - DNA, 100 bp, Artificial Sequence
  Description of Artificial Sequence: Synthetic polynucleotide
acgagctcctccgttcgacaggcgggggaagaggccgagccgggcgagagatgttgctatgaggacagattcatcaaaaatgactgacgtggagtctggg

SEQ ID NO: 2258 - DNA, 48 bp, Artificial Sequence
  Description of Artificial Sequence: Synthetic oligonucleotide
ggggaagaggccgagccgggcgagagatgttgctatgaggacagattc

SEQ ID NO: 2259 - DNA, 48 bp, Artificial Sequence; identical to SEQ ID NO: 2258
  Description of Artificial Sequence: Synthetic oligonucleotide

SEQ ID NO: 2260 - DNA, 100 bp, Artificial Sequence
  Description of Artificial Sequence: Synthetic polynucleotide
acgagctcctccgttcgacaggcgggggaagaggccgagccgggcgagagggggaacggtgtatttttaacaacgggaatcagtaactggaagtacaaga

SEQ ID NO: 2261 - DNA, 100 bp, Artificial Sequence
  Description of Artificial Sequence: Synthetic polynucleotide
taactctgggagaagcagaaaaccctgtgccagggacaggaaagataggaatgttgctatgaggacagattcatcaaaaatgactgacgtggagtctggg

SEQ ID NO: 2262 - DNA, 100 bp, Artificial Sequence
  Description of Artificial Sequence: Synthetic polynucleotide
acgagctcctccgttcgacaggcgggggaagaggccgagccgggcgagaggtaacccccttactgtcccctctggctcccccggctcccgacacccacga

SEQ ID NO: 2263 - DNA, 50 bp, Artificial Sequence
  Description of Artificial Sequence: Synthetic oligonucleotide
gccgggcgagaggtaacccccttactgtcccctctggctcccctggctcc

SEQ ID NO: 2264 - DNA, 100 bp, Artificial Sequence
  Description of Artificial Sequence: Synthetic polynucleotide
atttacttctgaataggctcatcttcttcatatgcacattctatttgtagatgttgctatgaggacagattcatcaaaaatgactgacgtggagtctggg

SEQ ID NO: 2265 - DNA, 100 bp, Artificial Sequence
  Description of Artificial Sequence: Synthetic polynucleotide
ccgtcactccccagggcggcatcgtcgtctatgggggctactcgaaacagctgcatcttcctcccgtgaggctggccgagctccacgctgatctgaagat

SEQ ID NO: 2266 - DNA, 50 bp, Artificial Sequence
  Description of Artificial Sequence: Synthetic oligonucleotide
atgggggctactcgaaacagctgcatcttcctcccgtgaggctggccgag

SEQ ID NO: 2267 - DNA, 50 bp, Artificial Sequence; identical to SEQ ID NO: 2266
  Description of Artificial Sequence: Synthetic oligonucleotide

SEQ ID NO: 2268 - DNA, 100 bp, Artificial Sequence
  Description of Artificial Sequence: Synthetic polynucleotide
ccgtcactccccagggcggcatcgtcgtctatgggggctactcgaaacagagagttaagaaagacgtggacaagggcacacggcactcagacatgttcct

SEQ ID NO: 2269 - DNA, 50 bp, Artificial Sequence
  Description of Artificial Sequence: Synthetic oligonucleotide
ggcatcgtcgtctatgggggctactcgaaacagagagttaagaaagacgt

SEQ ID NO: 2270 - DNA, 50 bp, Artificial Sequence
  Description of Artificial Sequence: Synthetic oligonucleotide
atgggggctactcgaaacagagagttaagaaagacgtggacaagggcaca

SEQ ID NO: 2271 - DNA, 50 bp, Artificial Sequence; identical to SEQ ID NO: 2270
  Description of Artificial Sequence: Synthetic oligonucleotide

SEQ ID NO: 2272 - DNA, 50 bp, Artificial Sequence
  Description of Artificial Sequence: Synthetic oligonucleotide
atgggggctacttgaaacagagagttaagaaagacgtggacaagggcaca

SEQ ID NO: 2273 - DNA, 50 bp, Artificial Sequence; identical to SEQ ID NO: 2270
  Description of Artificial Sequence: Synthetic oligonucleotide

SEQ ID NO: 2274 - DNA, 50 bp, Artificial Sequence; identical to SEQ ID NO: 2270
  Description of Artificial Sequence: Synthetic oligonucleotide

SEQ ID NO: 2275 - DNA, 50 bp, Artificial Sequence; identical to SEQ ID NO: 2270
  Description of Artificial Sequence: Synthetic oligonucleotide

SEQ ID NO: 2276 - DNA, 100 bp, Artificial Sequence
  Description of Artificial Sequence: Synthetic polynucleotide
aggagttccgcatggagaagttgaaccagctgtgggagaaggcccagcgactgcatcttcctcccgtgaggctggccgagctccacgctgatctgaagat

SEQ ID NO: 2277 - DNA, 50 bp, Artificial Sequence
  Description of Artificial Sequence: Synthetic oligonucleotide
tgtgggagaaggcccagcgactgcatcttcctcccgtgaggctggtcgag

SEQ ID NO: 2278 - DNA, 50 bp, Artificial Sequence
  Description of Artificial Sequence: Synthetic oligonucleotide
gtgggagaaggcccagcgactgcatcttcctcccgtgaggctggccgagc

SEQ ID NO: 2279 - DNA, 50 bp, Artificial Sequence; identical to SEQ ID NO: 2278
  Description of Artificial Sequence: Synthetic oligonucleotide

SEQ ID NO: 2280 - DNA, 49 bp, Artificial Sequence
  Description of Artificial Sequence: Synthetic oligonucleotide
aaggcccagcgactgcatcttcctcccgtgaggctggccgagctccacg

SEQ ID NO: 2281 - DNA, 49 bp, Artificial Sequence; identical to SEQ ID NO: 2280
  Description of Artificial Sequence: Synthetic oligonucleotide

SEQ ID NO: 2282 - DNA, 49 bp, Artificial Sequence
  Description of Artificial Sequence: Synthetic oligonucleotide
aggcccagcgactgcatcttcctcccgtgaggctggccgagctccacgc

SEQ ID NO: 2283 - DNA, 50 bp, Artificial Sequence
  Description of Artificial Sequence: Synthetic oligonucleotide
aggcccagcgactgcatcttcctcccgtgaggctggccgagctccacgct

SEQ ID NO: 2284 - DNA, 100 bp, Artificial Sequence
  Description of Artificial Sequence: Synthetic polynucleotide
ccgtcactccccagggcggcatcgtcgtctatgggggctactcgaaacaggtaaggcggggggtggggaaacaggcaaggcgttggaccgggaaacaggc

SEQ ID NO: 2285 - DNA, 100 bp, Artificial Sequence
  Description of Artificial Sequence: Synthetic polynucleotide
tcctggtccgtcctgctcgtggctcacaggctcctccccttcgttcgcagctgcatcttcctcccgtgaggctggccgagctccacgctgatctgaagat

SEQ ID NO: 2286 - DNA, 100 bp, Artificial Sequence
  Description of Artificial Sequence: Synthetic polynucleotide
gtaccaccgaactcgatctgggggagccagggatgaacgatatcgatcagagtcttgctctgtcgcccaggctggagtgcagtggtgcgaccttggctca

SEQ ID NO: 2287 - DNA, 50 bp, Artificial Sequence
  Description of Artificial Sequence: Synthetic oligonucleotide
gggggagccagggatgaacgatatcgatcagagtcttgctctgtcgccca

SEQ ID NO: 2288 - DNA, 100 bp, Artificial Sequence
  Description of Artificial Sequence: Synthetic polynucleotide
gtaccaccgaactcgatctgggggagccagggatgaacgatatcgatcagatatccacacagaagcagttcaggctgcactggcaaagcataaagaacag

SEQ ID NO: 2289 - DNA, 50 bp, Artificial Sequence
  Description of Artificial Sequence: Synthetic oligonucleotide
ctgggggagccagggatgaacgatatcgatcagatatccacacagaagca

SEQ ID NO: 2290 - DNA, 50 bp, Artificial Sequence
  Description of Artificial Sequence: Synthetic oligonucleotide
tgggggagccagggatgaacgatatcgatcagatatccacacagaagcag

SEQ ID NO: 2291 - DNA, 50 bp, Artificial Sequence; identical to SEQ ID NO: 2290
  Description of Artificial Sequence: Synthetic oligonucleotide

SEQ ID NO: 2292 - DNA, 50 bp, Artificial Sequence; identical to SEQ ID NO: 2290
  Description of Artificial Sequence: Synthetic oligonucleotide

SEQ ID NO: 2293 - DNA, 50 bp, Artificial Sequence; identical to SEQ ID NO: 2290
  Description of Artificial Sequence: Synthetic oligonucleotide

SEQ ID NO: 2294 - DNA, 50 bp, Artificial Sequence; identical to SEQ ID NO: 2290
  Description of Artificial Sequence: Synthetic oligonucleotide

SEQ ID NO: 2295 - DNA, 50 bp, Artificial Sequence; identical to SEQ ID NO: 2290
  Description of Artificial Sequence: Synthetic oligonucleotide

SEQ ID NO: 2296 - DNA, 50 bp, Artificial Sequence
  Description of Artificial Sequence: Synthetic oligonucleotide
gggggagccagggatgaacgatatcgatcagatatccacacagaagcagt

SEQ ID NO: 2297 - DNA, 50 bp, Artificial Sequence; identical to SEQ ID NO: 2296
  Description of Artificial Sequence: Synthetic oligonucleotide

SEQ ID NO: 2298 - DNA, 50 bp, Artificial Sequence; identical to SEQ ID NO: 2296
  Description of Artificial Sequence: Synthetic oligonucleotide

SEQ ID NO: 2299 - DNA, 50 bp, Artificial Sequence; identical to SEQ ID NO: 2296
  Description of Artificial Sequence: Synthetic oligonucleotide

SEQ ID NO: 2300 - DNA, 49 bp, Artificial Sequence
  Description of Artificial Sequence: Synthetic oligonucleotide
gggggagccagggatgaacgatatcgatcagatatccacacagaagcag

SEQ ID NO: 2301 - DNA, 50 bp, Artificial Sequence; identical to SEQ ID NO: 2296
  Description of Artificial Sequence: Synthetic oligonucleotide

SEQ ID NO: 2302 - DNA, 50 bp, Artificial Sequence; identical to SEQ ID NO: 2296
  Description of Artificial Sequence: Synthetic oligonucleotide

SEQ ID NO: 2303 - DNA, 50 bp, Artificial Sequence; identical to SEQ ID NO: 2296
  Description of Artificial Sequence: Synthetic oligonucleotide

SEQ ID NO: 2304 - DNA, 50 bp, Artificial Sequence; identical to SEQ ID NO: 2296
  Description of Artificial Sequence: Synthetic oligonucleotide

SEQ ID NO: 2305 - DNA, 50 bp, Artificial Sequence; identical to SEQ ID NO: 2296
  Description of Artificial Sequence: Synthetic oligonucleotide

SEQ ID NO: 2306 - DNA, 50 bp, Artificial Sequence; identical to SEQ ID NO: 2296
  Description of Artificial Sequence: Synthetic oligonucleotide

SEQ ID NO: 2307 - DNA, 50 bp, Artificial Sequence; identical to SEQ ID NO: 2296
  Description of Artificial Sequence: Synthetic oligonucleotide

SEQ ID NO: 2308 - DNA, 50 bp, Artificial Sequence
  Description of Artificial Sequence: Synthetic oligonucleotide
ggggagccagggatgaacgatatcgatcagatatccacacagaagcagtt

SEQ ID NO: 2309 - DNA, 50 bp, Artificial Sequence; identical to SEQ ID NO: 2308
  Description of Artificial Sequence: Synthetic oligonucleotide

SEQ ID NO: 2310 - DNA, 50 bp, Artificial Sequence
  Description of Artificial Sequence: Synthetic oligonucleotide
ggagccagggatgaacgatatcgatcagatatccacacagaagcagttca

SEQ ID NO: 2311 - DNA, 50 bp, Artificial Sequence; identical to SEQ ID NO: 2310
  Description of Artificial Sequence: Synthetic oligonucleotide

SEQ ID NO: 2312 - DNA, 50 bp, Artificial Sequence; identical to SEQ ID NO: 2310
  Description of Artificial Sequence: Synthetic oligonucleotide

SEQ ID NO: 2313 - DNA, 100 bp, Artificial Sequence; identical to SEQ ID NO: 1041
  Description of Artificial Sequence: Synthetic polynucleotide

SEQ ID NO: 2314 - DNA, 100 bp, Artificial Sequence
  Description of Artificial Sequence: Synthetic polynucleotide
gtaccaccgaactcgatctgggggagccagggatgaacgatatcgatcaggtgaggagaagctgcagaatggccagctgaatcgttttcctaacagtagt

SEQ ID NO: 2315 - DNA, 50 bp, Artificial Sequence
  Description of Artificial Sequence: Synthetic oligonucleotide
gggggagccagggatgaacgatatcgatcaggtgaggagaagctgcagaa

SEQ ID NO: 2316 - DNA, 50 bp, Artificial Sequence; identical to SEQ ID NO: 2315
  Description of Artificial Sequence: Synthetic oligonucleotide

SEQ ID NO: 2317 - DNA, 49 bp, Artificial Sequence
  Description of Artificial Sequence: Synthetic oligonucleotide
gggggagccagggatgaacgatatcgatcaggtgaggagaagctgcaga

SEQ ID NO: 2318 - DNA, 100 bp, Artificial Sequence; identical to SEQ ID NO: 1043
  Description of Artificial Sequence: Synthetic polynucleotide

SEQ ID NO: 2319 - DNA, 100 bp, Artificial Sequence
  Description of Artificial Sequence: Synthetic polynucleotide
acatgatgtagatcatcctggtgtgtccaatcaatttctgatcaatacaagacaagcatgactttcaggactctgtgagaataacgttggactttaatct

SEQ ID NO: 2320 - DNA, 50 bp, Artificial Sequence
  Description of Artificial Sequence: Synthetic oligonucleotide
tggtgtgtccaatcaatttctgatcaatacaagacaagcatgactttcag

SEQ ID NO: 2321 - DNA, 50 bp, Artificial Sequence
  Description of Artificial Sequence: Synthetic oligonucleotide
ggtgtgtccaatcaatttctgatcaatacaagacaagcatgactttcagg

SEQ ID NO: 2322 - DNA, 100 bp, Artificial Sequence
  Description of Artificial Sequence: Synthetic polynucleotide
acatgatgtagatcatcctggtgtgtccaatcaatttctgatcaatacaaactctgaacttgccttgatgtacaatgattcctcagtcttagagaaccat

SEQ ID NO: 2323 - DNA, 50 bp, Artificial Sequence
  Description of Artificial Sequence: Synthetic oligonucleotide
ggtgtgtccaatcaatttctgatcaatacaaactctgaacttgccttgat

SEQ ID NO: 2324 - DNA, 100 bp, Artificial Sequence
  Description of Artificial Sequence: Synthetic polynucleotide
acatcacagttcgaaaatcagaatgcactaagcactccttctacatgttggacaagcatgactttcaggactctgtgagaataacgttggactttaatct

SEQ ID NO: 2325 - DNA, 100 bp, Artificial Sequence
  Description of Artificial Sequence: Synthetic polynucleotide
acatgatgtagatcatcctggtgtgtccaatcaatttctgatcaatacaagtaagtaaactttattttttcagaacacatttttcccttgtacattttag

SEQ ID NO: 2326 - DNA, 100 bp, Artificial Sequence
  Description of Artificial Sequence: Synthetic polynucleotide
acacccggtaaatatgataccagtgatatattttatgtttcaccctctaggacaagcatgactttcaggactctgtgagaataacgttggactttaatct

SEQ ID NO: 2327 - DNA, 100 bp, Artificial Sequence; identical to SEQ ID NO: 1038
  Description of Artificial Sequence: Synthetic polynucleotide

SEQ ID NO: 2328 - DNA, 50 bp, Artificial Sequence
  Description of Artificial Sequence: Synthetic oligonucleotide
gctggtggccaacagtttgcggatactcttctgagtcttgctctgtcgcc

SEQ ID NO: 2329 - DNA, 100 bp, Artificial Sequence; identical to SEQ ID NO: 1040
  Description of Artificial Sequence: Synthetic polynucleotide

SEQ ID NO: 2330 - DNA, 100 bp, Artificial Sequence; identical to SEQ ID NO: 1041
  Description of Artificial Sequence: Synthetic polynucleotide

SEQ ID NO: 2331 - DNA, 100 bp, Artificial Sequence; identical to SEQ ID NO: 1042
  Description of Artificial Sequence: Synthetic polynucleotide

SEQ ID NO: 2332 - DNA, 100 bp, Artificial Sequence; identical to SEQ ID NO: 1043
  Description of Artificial Sequence: Synthetic polynucleotide

SEQ ID NO: 2333 - DNA, 100 bp, Artificial Sequence
  Description of Artificial Sequence: Synthetic polynucleotide
atgaggaagtactgagcctgttggaggaactggcccggaaacaggaggacgcccagggccccggccagtgcccagccccgctgggagacccggccagcac

SEQ ID NO: 2334 - DNA, 50 bp, Artificial Sequence
  Description of Artificial Sequence: Synthetic oligonucleotide
ggcccggaaacaggaggacgcccagggccccggccagtgcccagccccgc

SEQ ID NO: 2335 - DNA, 50 bp, Artificial Sequence; identical to SEQ ID NO: 2334
  Description of Artificial Sequence: Synthetic oligonucleotide

SEQ ID NO: 2336 - DNA, 100 bp, Artificial Sequence
  Description of Artificial Sequence: Synthetic polynucleotide
atgaggaagtactgagcctgttggaggaactggcccggaaacaggaggaccttcggaaccaaaaagaagcttcccagagccggggccaggagccccaagc

SEQ ID NO: 2337 - DNA, 100 bp, Artificial Sequence
  Description of Artificial Sequence: Synthetic polynucleotide
tcagcttccgggggactttggagagggtcgaggctcagtgggagctggaggcccagggccccggccagtgcccagccccgctgggagacccggccagcac

SEQ ID NO: 2338 - DNA, 100 bp, Artificial Sequence
  Description of Artificial Sequence: Synthetic polynucleotide
atgaggaagtactgagcctgttggaggaactggcccggaaacaggaggacgtgagtgtcagggctgaggggcttaccccagactccccatgtcccctcag

SEQ ID NO: 2339 - DNA, 100 bp, Artificial Sequence
  Description of Artificial Sequence: Synthetic polynucleotide
gtgctggccggtaggccgggcccagcttgctctcactttctcctctccaggcccagggccccggccagtgcccagccccgctgggagacccggccagcac

SEQ ID NO: 2340 - DNA, 100 bp, Artificial Sequence
  Description of Artificial Sequence: Synthetic polynucleotide
ccagagcctgaggtgggcagtgtgccagggtcccttgcggcctcctcaaggttttgaacgaagaatgtgatcagaactggtacaaggcagagcttaatgg

SEQ ID NO: 2341 - DNA, 50 bp, Artificial Sequence
  Description of Artificial Sequence: Synthetic oligonucleotide
tgcggcctcctcaaggttttgaacgaagaatgtgatcagaactagtacaa

SEQ ID NO: 2342 - DNA, 50 bp, Artificial Sequence
  Description of Artificial Sequence: Synthetic oligonucleotide
tgcggcctcctcaaggttttgaacgaagaatgtgatcagaactggtacaa

SEQ ID NO: 2343 - DNA, 50 bp, Artificial Sequence; identical to SEQ ID NO: 2342
  Description of Artificial Sequence: Synthetic oligonucleotide

SEQ ID NO: 2344 - DNA, 50 bp, Artificial Sequence; identical to SEQ ID NO: 2342
  Description of Artificial Sequence: Synthetic oligonucleotide

SEQ ID NO: 2345 - DNA, 100 bp, Artificial Sequence
  Description of Artificial Sequence: Synthetic polynucleotide
ccagagcctgaggtgggcagtgtgccagggtcccttgcggcctcctcaagccctgtccaggctatgggcatcaagacagcattgccggcggctgagctgg

SEQ ID NO: 2346 - DNA, 100 bp, Artificial Sequence
  Description of Artificial Sequence: Synthetic polynucleotide
aagctactgcagacgacgagctgagcttcaaaaggggggacatcctcaaggttttgaacgaagaatgtgatcagaactggtacaaggcagagcttaatgg

SEQ ID NO: 2347 - DNA, 50 bp, Artificial Sequence
  Description of Artificial Sequence: Synthetic oligonucleotide
actgcagacgacgagctgagcttcaaaaggggggacatcctcaaggtttt

SEQ ID NO: 2348 - DNA, 50 bp, Artificial Sequence; identical to SEQ ID NO: 2347
  Description of Artificial Sequence: Synthetic oligonucleotide

SEQ ID NO: 2349 - DNA, 50 bp, Artificial Sequence; identical to SEQ ID NO: 2347
  Description of Artificial Sequence: Synthetic oligonucleotide

SEQ ID NO: 2350 - DNA, 50 bp, Artificial Sequence; identical to SEQ ID NO: 2347
  Description of Artificial Sequence: Synthetic oligonucleotide

SEQ ID NO: 2351 - DNA, 50 bp, Artificial Sequence
  Description of Artificial Sequence: Synthetic oligonucleotide
gcagacgacgagctgagcttcaaaaggggggacattctcaaggttttgaa

SEQ ID NO: 2352 - DNA, 50 bp, Artificial Sequence; identical to SEQ ID NO: 2351
  Description of Artificial Sequence: Synthetic oligonucleotide

SEQ ID NO: 2353 - DNA, 50 bp, Artificial Sequence
  Description of Artificial Sequence: Synthetic oligonucleotide
aaggggggacatcctcaaggttttgaacgaagaatgtgatcagaactggt

SEQ ID NO: 2354 - DNA, 50 bp, Artificial Sequence
  Description of Artificial Sequence: Synthetic oligonucleotide
aaggggggacatcctcaaggttttgaacgaagaatgtgaccagaactggt

SEQ ID NO: 2355 - DNA, 50 bp, Artificial Sequence; identical to SEQ ID NO: 2353
  Description of Artificial Sequence: Synthetic oligonucleotide

SEQ ID NO: 2356 - DNA, 50 bp, Artificial Sequence; identical to SEQ ID NO: 2353
  Description of Artificial Sequence: Synthetic oligonucleotide

SEQ ID NO: 2357 - DNA, 50 bp, Artificial Sequence; identical to SEQ ID NO: 2353
  Description of Artificial Sequence: Synthetic oligonucleotide

SEQ ID NO: 2358 - DNA, 50 bp, Artificial Sequence
  Description of Artificial Sequence: Synthetic oligonucleotide
aggggggacatcctcaaggttttgaacgaagaatgtgatcagaactggta

SEQ ID NO: 2359 - DNA, 50 bp, Artificial Sequence; identical to SEQ ID NO: 2358
  Description of Artificial Sequence: Synthetic oligonucleotide

SEQ ID NO: 2360 - DNA, 50 bp, Artificial Sequence; identical to SEQ ID NO: 2358
  Description of Artificial Sequence: Synthetic oligonucleotide

SEQ ID NO: 2361 - DNA, 50 bp, Artificial Sequence; identical to SEQ ID NO: 2358
  Description of Artificial Sequence: Synthetic oligonucleotide

SEQ ID NO: 2362 - DNA, 50 bp, Artificial Sequence; identical to SEQ ID NO: 2358
  Description of Artificial Sequence: Synthetic oligonucleotide

SEQ ID NO: 2363 - DNA, 50 bp, Artificial Sequence
  Description of Artificial Sequence: Synthetic oligonucleotide
ggggggacatcctcaaggttttgaacgaagaatgtgatcagaactggtac

SEQ ID NO: 2364 - DNA, 50 bp, Artificial Sequence
  Description of Artificial Sequence: Synthetic oligonucleotide
gggggacatcctcaaggttttgaacgaagaatgtgatcagaactggtaca

SEQ ID NO: 2365 - DNA, 50 bp, Artificial Sequence; identical to SEQ ID NO: 2364
  Description of Artificial Sequence: Synthetic oligonucleotide

SEQ ID NO: 2366 - DNA, 50 bp, Artificial Sequence; identical to SEQ ID NO: 2364
  Description of Artificial Sequence: Synthetic oligonucleotide

SEQ ID NO: 2367 - DNA, 49 bp, Artificial Sequence
  Description of Artificial Sequence: Synthetic oligonucleotide
gggggacatcctcaaggttttgaacgaagaatgtgatcagaactggtac

SEQ ID NO: 2368 - DNA, 50 bp, Artificial Sequence; identical to SEQ ID NO: 2364
  Description of Artificial Sequence: Synthetic oligonucleotide

SEQ ID NO: 2369 - DNA, 50 bp, Artificial Sequence; identical to SEQ ID NO: 2364
  Description of Artificial Sequence: Synthetic oligonucleotide

SEQ ID NO: 2370 - DNA, 50 bp, Artificial Sequence; identical to SEQ ID NO: 2364
  Description of Artificial Sequence: Synthetic oligonucleotide

SEQ ID NO: 2371 - DNA, 50 bp, Artificial Sequence; identical to SEQ ID NO: 2364
  Description of Artificial Sequence: Synthetic oligonucleotide

SEQ ID NO: 2372 - DNA, 49 bp, Artificial Sequence; identical to SEQ ID NO: 2367
  Description of Artificial Sequence: Synthetic oligonucleotide

SEQ ID NO: 2373 - DNA, 49 bp, Artificial Sequence; identical to SEQ ID NO: 2367
  Description of Artificial Sequence: Synthetic oligonucleotide

SEQ ID NO: 2374 - DNA, 50 bp, Artificial Sequence; identical to SEQ ID NO: 2364
  Description of Artificial Sequence: Synthetic oligonucleotide

SEQ ID NO: 2375 - DNA, 49 bp, Artificial Sequence
  Description of Artificial Sequence: Synthetic oligonucleotide
ggggacatcctcaaggttttgaacgaagaatgtgatcagaactggtaca

SEQ ID NO: 2376 - DNA, 49 bp, Artificial Sequence; identical to SEQ ID NO: 2375
  Description of Artificial Sequence: Synthetic oligonucleotide

SEQ ID NO: 2377 - DNA, 49 bp, Artificial Sequence; identical to SEQ ID NO: 2375
  Description of Artificial Sequence: Synthetic oligonucleotide

SEQ ID NO: 2378 - DNA, 49 bp, Artificial Sequence; identical to SEQ ID NO: 2375
  Description of Artificial Sequence: Synthetic oligonucleotide

SEQ ID NO: 2379 - DNA, 49 bp, Artificial Sequence; identical to SEQ ID NO: 2375
  Description of Artificial Sequence: Synthetic oligonucleotide

SEQ ID NO: 2380 - DNA, 50 bp, Artificial Sequence
  Description of Artificial Sequence: Synthetic oligonucleotide
ggggacatcctcaaggttttgaacgaagaatgtgatcagaactggtacaa

SEQ ID NO: 2381 - DNA, 50 bp, Artificial Sequence; identical to SEQ ID NO: 2380
  Description of Artificial Sequence: Synthetic oligonucleotide

SEQ ID NO: 2382 - DNA, 50 bp, Artificial Sequence; identical to SEQ ID NO: 2380
  Description of Artificial Sequence: Synthetic oligonucleotide

SEQ ID NO: 2383 - DNA, 50 bp, Artificial Sequence
  Description of Artificial Sequence: Synthetic oligonucleotide
gggacatcctcaaggttttgaacgaagaatgtgatcagaactggtacaag

SEQ ID NO: 2384 - DNA, 50 bp, Artificial Sequence; identical to SEQ ID NO: 2383
  Description of Artificial Sequence: Synthetic oligonucleotide

SEQ ID NO: 2385 - DNA, 49 bp, Artificial Sequence
  Description of Artificial Sequence: Synthetic oligonucleotide
gggacatcctcaaggttttgaacgaagaatgtgatcagaactggtacaa

SEQ ID NO: 2386 - DNA, 50 bp, Artificial Sequence; identical to SEQ ID NO: 2383
  Description of Artificial Sequence: Synthetic oligonucleotide

SEQ ID NO: 2387 - DNA, 50 bp, Artificial Sequence; identical to SEQ ID NO: 2383
  Description of Artificial Sequence: Synthetic oligonucleotide

SEQ ID NO: 2388 - DNA, 50 bp, Artificial Sequence; identical to SEQ ID NO: 2383
  Description of Artificial Sequence: Synthetic oligonucleotide

SEQ ID NO: 2389 - DNA, 50 bp, Artificial Sequence; identical to SEQ ID NO: 2383
  Description of Artificial Sequence: Synthetic oligonucleotide

SEQ ID NO: 2390 - DNA, 50 bp, Artificial Sequence; identical to SEQ ID NO: 2383
  Description of Artificial Sequence: Synthetic oligonucleotide

SEQ ID NO: 2391 - DNA, 50 bp, Artificial Sequence; identical to SEQ ID NO: 2383
  Description of Artificial Sequence: Synthetic oligonucleotide

SEQ ID NO: 2392 - DNA, 50 bp, Artificial Sequence
  Description of Artificial Sequence: Synthetic oligonucleotide
gacatcctcaaggttttgaacgaagaatgtgatcagaactggtacaaggc

SEQ ID NO: 2393 - DNA, 100 bp, Artificial Sequence
  Description of Artificial Sequence: Synthetic polynucleotide
ccagagcctgaggtgggcagtgtgccagggtcccttgcggcctcctcaaggtcagtgccagctggggatgcagctactctggggctcttgagacttgtgg

SEQ ID NO: 2394 - DNA, 100 bp, Artificial Sequence
  Description of Artificial Sequence: Synthetic polynucleotide
aaagggaaaaggaaatgattgggtttttttgttgtcttatttcttttcaggttttgaacgaagaatgtgatcagaactggtacaaggcagagcttaatgg

SEQ ID NO: 2395 - DNA, 100 bp, Artificial Sequence
  Description of Artificial Sequence: Synthetic polynucleotide
aacgactgcatctttgacaagtttgagtgttgctggaacggttcggatagggttattttggagccgttggggcactgttggaactgttcaaaatgactga

SEQ ID NO: 2396 - DNA, 50 bp, Artificial Sequence
  Description of Artificial Sequence: Synthetic oligonucleotide
ggaacggttcggatagggttattttggagccgttggggcactgttggaac

SEQ ID NO: 2397 - DNA, 50 bp, Artificial Sequence; identical to SEQ ID NO: 2396
  Description of Artificial Sequence: Synthetic oligonucleotide

SEQ ID NO: 2398 - DNA, 50 bp, Artificial Sequence; identical to SEQ ID NO: 2396
  Description of Artificial Sequence: Synthetic oligonucleotide

SEQ ID NO: 2399 - DNA, 50 bp, Artificial Sequence; identical to SEQ ID NO: 2396
  Description of Artificial Sequence: Synthetic oligonucleotide

SEQ ID NO: 2400 - DNA, 50 bp, Artificial Sequence; identical to SEQ ID NO: 2396
  Description of Artificial Sequence: Synthetic oligonucleotide

SEQ ID NO: 2401 - DNA, 50 bp, Artificial Sequence; identical to SEQ ID NO: 2396
  Description of Artificial Sequence: Synthetic oligonucleotide

SEQ ID NO: 2402 - DNA, 50 bp, Artificial Sequence; identical to SEQ ID NO: 2396
  Description of Artificial Sequence: Synthetic oligonucleotide

SEQ ID NO: 2403 - DNA, 50 bp, Artificial Sequence; identical to SEQ ID NO: 2396
  Description of Artificial Sequence: Synthetic oligonucleotide

SEQ ID NO: 2404 - DNA, 50 bp, Artificial Sequence
  Description of Artificial Sequence: Synthetic oligonucleotide
ggaacggttcggatagggttattttggagccgttggggcactgatggaac

SEQ ID NO: 2405 - DNA, 50 bp, Artificial Sequence; identical to SEQ ID NO: 2396
  Description of Artificial Sequence: Synthetic oligonucleotide

SEQ ID NO: 2406 - DNA, 100 bp, Artificial Sequence
  Description of Artificial Sequence: Synthetic polynucleotide
aacgactgcatctttgacaagtttgagtgttgctggaacggttcggatagcgccatcatgaccgggtcctataacaacttcttcaggatgtttgatagag

SEQ ID NO: 2407 - DNA, 100 bp, Artificial Sequence
  Description of Artificial Sequence: Synthetic polynucleotide
tggatttttggtccaaaggacaactgaaagctctgtttttggaacatgagggttattttggagccgttggggcactgttggaactgttcaaaatgactga

SEQ ID NO: 2408 - DNA, 100 bp, Artificial Sequence
  Description of Artificial Sequence: Synthetic polynucleotide
aacgactgcatctttgacaagtttgagtgttgctggaacggttcggataggtaaggcctgcgtggagatgagctgtcgccccaagcttgctggtttccga

SEQ ID NO: 2409 - DNA, 100 bp, Artificial Sequence
  Description of Artificial Sequence: Synthetic polynucleotide
tacatatttggctaaggttcagagatcatcgttttgtattgttttcgtagggttattttggagccgttggggcactgttggaactgttcaaaatgactga

SEQ ID NO: 2410 - DNA, 100 bp, Artificial Sequence
  Description of Artificial Sequence: Synthetic polynucleotide
actttattgattcagtgggaaatgatgtggatgttgtctctgactctgaagtgaggagaagatgctgttctgagagctgctgataatacgtggatccaaa

SEQ ID NO: 2411 - DNA, 49 bp, Artificial Sequence
  Description of Artificial Sequence: Synthetic oligonucleotide
gtgggaaatgatgtggatgttgtctctgactctgaagtgaggagaagat

SEQ ID NO: 2412 - DNA, 49 bp, Artificial Sequence; identical to SEQ ID NO: 2411
  Description of Artificial Sequence: Synthetic oligonucleotide

SEQ ID NO: 2413 - DNA, 49 bp, Artificial Sequence; identical to SEQ ID NO: 2411
  Description of Artificial Sequence: Synthetic oligonucleotide

SEQ ID NO: 2414 - DNA, 50 bp, Artificial Sequence
  Description of Artificial Sequence: Synthetic oligonucleotide
ggatgttgtctctgactctgaagtgaggagaagatgctgttctgagagct

SEQ ID NO: 2415 - DNA, 50 bp, Artificial Sequence
  Description of Artificial Sequence: Synthetic oligonucleotide
ggatgttgtctctgactctgaagtgaggagaagatgctgtcctgagagct

SEQ ID NO: 2416 - DNA, 100 bp, Artificial Sequence
  Description of Artificial Sequence: Synthetic polynucleotide
actttattgattcagtgggaaatgatgtggatgttgtctctgactctgaaaacataaaaaaactcctgaaaattccctacagcaagtcgcacgtgagcat

SEQ ID NO: 2417 - DNA, 50 bp, Artificial Sequence
  Description of Artificial Sequence: Synthetic oligonucleotide
gggaaatgatgtggatgttgtctctgactctgaaaacataaaaaaactcc

SEQ ID NO: 2418 - DNA, 50 bp, Artificial Sequence; identical to SEQ ID NO: 2417
  Description of Artificial Sequence: Synthetic oligonucleotide

SEQ ID NO: 2419 - DNA, 100 bp, Artificial Sequence
  Description of Artificial Sequence: Synthetic polynucleotide
gtaaacttcacatccatcggggaagttaccctttgggattactgatgaaggtgaggagaagatgctgttctgagagctgctgataatacgtggatccaaa

SEQ ID NO: 2420 - DNA, 100 bp, Artificial Sequence
  Description of Artificial Sequence: Synthetic polynucleotide
actttattgattcagtgggaaatgatgtggatgttgtctctgactctgaagtaagtgttatttgtcgcttaatgtaattttggaggtgttttgtgatagg

SEQ ID NO: 2421 - DNA, 50 bp, Artificial Sequence
  Description of Artificial Sequence: Synthetic oligonucleotide
gatgtggatgttgtctctgactctgaagtaagtgttatttgttgcttaat

SEQ ID NO: 2422 - DNA, 50 bp, Artificial Sequence; identical to SEQ ID NO: 2421
  Description of Artificial Sequence: Synthetic oligonucleotide

SEQ ID NO: 2423 - DNA, 100 bp, Artificial Sequence
  Description of Artificial Sequence: Synthetic polynucleotide
tgtgggatgtgggcgataacagggttttctaaaagcactttctgcttcaggtgaggagaagatgctgttctgagagctgctgataatacgtggatccaaa

SEQ ID NO: 2424 - DNA, 100 bp, Artificial Sequence
  Description of Artificial Sequence: Synthetic polynucleotide
gtgtgacgggctgcctgactgcttcgacaagagtgatgagaaggagtgcctctgatgccaatgcaagttacttaagagcagctcgagctggacaccttga

SEQ ID NO: 2425 - DNA, 50 bp, Artificial Sequence
  Description of Artificial Sequence: Synthetic oligonucleotide
gcctgactgcttcgacaagagtgatgagaaggagtgcctctgatgccaat

SEQ ID NO: 2426 - DNA, 50 bp, Artificial Sequence
  Description of Artificial Sequence: Synthetic oligonucleotide
gactgcttcgacaagagtgatgagaaggagtgcctctgatgccaatgcaa

SEQ ID NO: 2427 - DNA, 100 bp, Artificial Sequence
  Description of Artificial Sequence: Synthetic polynucleotide
gtgtgacgggctgcctgactgcttcgacaagagtgatgagaaggagtgccccaaggctaagtcgaaatgtggcccaaccttcttcccctgtgccagcggc

SEQ ID NO: 2428 - DNA, 100 bp, Artificial Sequence
  Description of Artificial Sequence: Synthetic polynucleotide
ctgagaaaaaaaggaaacaccgcaaacggtcccgggatcggaagaaaaagtctgatgccaatgcaagttacttaagagcagctcgagctggacaccttga

SEQ ID NO: 2429 - DNA, 100 bp, Artificial Sequence
  Description of Artificial Sequence: Synthetic polynucleotide
gtgtgacgggctgcctgactgcttcgacaagagtgatgagaaggagtgccgtgagtggcctggccctttgctggggtggggtggcagccatcctggggca

SEQ ID NO: 2430 - DNA, 100 bp, Artificial Sequence
  Description of Artificial Sequence: Synthetic polynucleotide
atgcatattagcttcatttttcatcaaaatgtgtttcttttttattttagtctgatgccaatgcaagttacttaagagcagctcgagctggacaccttga

SEQ ID NO: 2431 - DNA, 100 bp, Artificial Sequence
  Description of Artificial Sequence: Synthetic polynucleotide
tgctggcggtcgggagagcggcggcagcgagaggcgagccagcggcgacgaaaaataactaaacatgggcaaaggagatcctaagaagccgagaggcaaa

SEQ ID NO: 2432 - DNA, 50 bp, Artificial Sequence
  Description of Artificial Sequence: Synthetic oligonucleotide
agaggcgagccagcggcgacgaaaaataactaaacatgggcaaaggagat

SEQ ID NO: 2433 - DNA, 50 bp, Artificial Sequence; identical to SEQ ID NO: 2432
  Description of Artificial Sequence: Synthetic oligonucleotide

SEQ ID NO: 2434 - DNA, 50 bp, Artificial Sequence; identical to SEQ ID NO: 2432
  Description of Artificial Sequence: Synthetic oligonucleotide

SEQ ID NO: 2435 - DNA, 50 bp, Artificial Sequence; identical to SEQ ID NO: 2432
  Description of Artificial Sequence: Synthetic oligonucleotide

SEQ ID NO: 2436 - DNA, 50 bp, Artificial Sequence; identical to SEQ ID NO: 2432
  Description of Artificial Sequence: Synthetic oligonucleotide

SEQ ID NO: 2437 - DNA, 50 bp, Artificial Sequence; identical to SEQ ID NO: 2432
  Description of Artificial Sequence: Synthetic oligonucleotide

SEQ ID NO: 2438 - DNA, 50 bp, Artificial Sequence; identical to SEQ ID NO: 2432
  Description of Artificial Sequence: Synthetic oligonucleotide

SEQ ID NO: 2439 - DNA, 50 bp, Artificial Sequence; identical to SEQ ID NO: 2432
  Description of Artificial Sequence: Synthetic oligonucleotide

SEQ ID NO: 2440 - DNA, 100 bp, Artificial Sequence
  Description of Artificial Sequence: Synthetic polynucleotide
tgctggcggtcgggagagcggcggcagcgagaggcgagccagcggcgacgaatgaagaactttttcacttactgcaggattttcagcttcagcaagcagg

SEQ ID NO: 2441 - DNA, 50 bp, Artificial Sequence
  Description of Artificial Sequence: Synthetic oligonucleotide
agcggcgacgaatgaagaacttttttacttactgcaggattttcagcttc

SEQ ID NO: 2442 - DNA, 50 bp, Artificial Sequence; identical to SEQ ID NO: 2441
  Description of Artificial Sequence: Synthetic oligonucleotide

SEQ ID NO: 2443 - DNA, 50 bp, Artificial Sequence; identical to SEQ ID NO: 2441
  Description of Artificial Sequence: Synthetic oligonucleotide

SEQ ID NO: 2444 - DNA, 50 bp, Artificial Sequence; identical to SEQ ID NO: 2441
  Description of Artificial Sequence: Synthetic oligonucleotide

SEQ ID NO: 2445 - DNA, 50 bp, Artificial Sequence; identical to SEQ ID NO: 2441
  Description of Artificial Sequence: Synthetic oligonucleotide

SEQ ID NO: 2446 - DNA, 50 bp, Artificial Sequence; identical to SEQ ID NO: 2441
  Description of Artificial Sequence: Synthetic oligonucleotide

SEQ ID NO: 2447 - DNA, 100 bp, Artificial Sequence
  Description of Artificial Sequence: Synthetic polynucleotide
gggcaagtgagagccggacgggcactgggcgactctgtgcctcgctgaggaaaaataactaaacatgggcaaaggagatcctaagaagccgagaggcaaa

SEQ ID NO: 2448 - DNA, 100 bp, Artificial Sequence
  Description of Artificial Sequence: Synthetic polynucleotide
tgctggcggtcgggagagcggcggcagcgagaggcgagccagcggcgacggtgagtgtgcaggcgcgggggcgaagcggccgcccccacccccatcccca

SEQ ID NO: 2449 - DNA, 100 bp, Artificial Sequence
  Description of Artificial Sequence: Synthetic polynucleotide
tatatgtcataattttattgctaacatcaaatatttattttattttttagaaaaataactaaacatgggcaaaggagatcctaagaagccgagaggcaaa

SEQ ID NO: 2450 - DNA, 100 bp, Artificial Sequence
  Description of Artificial Sequence: Synthetic polynucleotide
cggctgcaactgcctgccgcgccgagggaccgccgggcggcggaaagcaggagttccgattctgaagaggcatttgagaccccggagtcaacgacccctg

SEQ ID NO: 2451 - DNA, 50 bp, Artificial Sequence
  Description of Artificial Sequence: Synthetic oligonucleotide
ccgggcggcggaaagcaggagttccgattctgaagaggcatttgagaccc

SEQ ID NO: 2452 - DNA, 100 bp, Artificial Sequence
  Description of Artificial Sequence: Synthetic polynucleotide
cggctgcaactgcctgccgcgccgagggaccgccgggcggcggaaagcaggttataaaacatggaggctggctcagtggttcgagccatttttgacttct

SEQ ID NO: 2453 - DNA, 50 bp, Artificial Sequence
  Description of Artificial Sequence: Synthetic oligonucleotide
cggcggaaagcaggttataaaacatggaggctggctcagtggttcgagcc

SEQ ID NO: 2454 - DNA, 50 bp, Artificial Sequence; identical to SEQ ID NO: 2453
  Description of Artificial Sequence: Synthetic oligonucleotide

SEQ ID NO: 2455 - DNA, 50 bp, Artificial Sequence
  Description of Artificial Sequence: Synthetic oligonucleotide
cggcggaaagcaggttataaaacatggaggctgggtcagtggttcgagcc

SEQ ID NO: 2456 - DNA, 50 bp, Artificial Sequence; identical to SEQ ID NO: 2453
  Description of Artificial Sequence: Synthetic oligonucleotide

SEQ ID NO: 2457 - DNA, 100 bp, Artificial Sequence
  Description of Artificial Sequence: Synthetic polynucleotide
ctgcagccagccccagccagcgacctgaacctggaggcttccgaggcaatgagttccgattctgaagaggcatttgagaccccggagtcaacgacccctg

SEQ ID NO: 2458 - DNA, 100 bp, Artificial Sequence
  Description of Artificial Sequence: Synthetic polynucleotide
cggctgcaactgcctgccgcgccgagggaccgccgggcggcggaaagcaggtcagaggccgggccaggccggagccgggcgggggccgggcggggagcgg

SEQ ID NO: 2459 - DNA, 100 bp, Artificial Sequence
  Description of Artificial Sequence: Synthetic polynucleotide
gaactggctctgggcccctgtctaacctgtgcttctccctctctcatcaggagttccgattctgaagaggcatttgagaccccggagtcaacgacccctg

SEQ ID NO: 2460 - DNA, 100 bp, Artificial Sequence
  Description of Artificial Sequence: Synthetic polynucleotide
gacgagccggccgtcccgggccgggggacccgcccgccatggccaccaaggcatttattaatacagcaaaagaaatttatgaaaaaattcaagaaggagt

SEQ ID NO: 2461 - DNA, 49 bp, Artificial Sequence
  Description of Artificial Sequence: Synthetic oligonucleotide
ccgcccgccatggccaccaaggcatttattaatacagcaaaagaaattt

SEQ ID NO: 2462 - DNA, 100 bp, Artificial Sequence
  Description of Artificial Sequence: Synthetic polynucleotide
gacgagccggccgtcccgggccgggggacccgcccgccatggccaccaaggctcgggttatgtatgattttgctgctgaacctggaaataatgaactgac

SEQ ID NO: 2463 - DNA, 100 bp, Artificial Sequence
  Description of Artificial Sequence: Synthetic polynucleotide
gactcatcttcatggaaacgtctgctaagactgcttccaatgtagaagaggcatttattaatacagcaaaagaaatttatgaaaaaattcaagaaggagt

SEQ ID NO: 2464 - DNA, 100 bp, Artificial Sequence
  Description of Artificial Sequence: Synthetic polynucleotide
gacgagccggccgtcccgggccgggggacccgcccgccatggccaccaaggtgaggggcgcgcggcgcaggccgggccggtcgctcaggcccggggcggc

SEQ ID NO: 2465 - DNA, 100 bp, Artificial Sequence
  Description of Artificial Sequence: Synthetic polynucleotide
ttttactgctttggttttatataatatgaaccaatttctctatatttcaggcatttattaatacagcaaaagaaatttatgaaaaaattcaagaaggagt

SEQ ID NO: 2466 - DNA, 100 bp, Artificial Sequence
  Description of Artificial Sequence: Synthetic polynucleotide
tcctgaccccgtacctgctggggccggacaagaacctgaccgagagggagtagccggatcgagctgggagatgtgacaccacacaatattaaacagttga

SEQ ID NO: 2467 - DNA, 49 bp, Artificial Sequence
  Description of Artificial Sequence: Synthetic oligonucleotide
ggggccggacaagaacctgaccgagagggagtagccggatcgagctggg

SEQ ID NO: 2468 - DNA, 100 bp, Artificial Sequence
  Description of Artificial Sequence: Synthetic polynucleotide
tcctgaccccgtacctgctggggccggacaagaacctgaccgagagggaggtcttcaatgaaatttatccagtatggacttactcttacctggtgctact

SEQ ID NO: 2469 - DNA, 50 bp, Artificial Sequence
  Description of Artificial Sequence: Synthetic oligonucleotide
gctggggccgaacaagaacctgaccgagagggaggtcttcaatgaaattt

SEQ ID NO: 2470 - DNA, 50 bp, Artificial Sequence; identical to SEQ ID NO: 2469
  Description of Artificial Sequence: Synthetic oligonucleotide

SEQ ID NO: 2471 - DNA, 50 bp, Artificial Sequence
  Description of Artificial Sequence: Synthetic oligonucleotide
ggggccggacaagaaccttaccgagagggaggtcttcaatgaaatttatc

SEQ ID NO: 2472 - DNA, 50 bp, Artificial Sequence
  Description of Artificial Sequence: Synthetic oligonucleotide
gggccggacaagaacctgaccgagagggaggtcttcaatgaaatttatcc

SEQ ID NO: 2473 - DNA, 50 bp, Artificial Sequence; identical to SEQ ID NO: 2472
  Description of Artificial Sequence: Synthetic oligonucleotide

SEQ ID NO: 2474 - DNA, 50 bp, Artificial Sequence; identical to SEQ ID NO: 2472
  Description of Artificial Sequence: Synthetic oligonucleotide

SEQ ID NO: 2475 - DNA, 50 bp, Artificial Sequence; identical to SEQ ID NO: 2472
  Description of Artificial Sequence: Synthetic oligonucleotide

SEQ ID NO: 2476 - DNA, 100 bp, Artificial Sequence
  Description of Artificial Sequence: Synthetic polynucleotide
cgttgatatcggtggtaacgacggcctcagcaggcggggaagatgaaaggtagccggatcgagctgggagatgtgacaccacacaatattaaacagttga

SEQ ID NO: 2477 - DNA, 50 bp, Artificial Sequence
  Description of Artificial Sequence: Synthetic oligonucleotide
agcaggcggggaagatgaaaggtagccggatcgagctgggagttgtgaca

SEQ ID NO: 2478 - DNA, 50 bp, Artificial Sequence
  Description of Artificial Sequence: Synthetic oligonucleotide
agcaggcggggaagatgaaaggtagccggatcgagctgggagatgtgaca

SEQ ID NO: 2479 - DNA, 49 bp, Artificial Sequence
  Description of Artificial Sequence: Synthetic oligonucleotide
gcaggcggggaagatgaaaggtagccggatcgagctgggagatgtgaca

SEQ ID NO: 2480 - DNA, 50 bp, Artificial Sequence
  Description of Artificial Sequence: Synthetic oligonucleotide
caggcggggaagatgaaaggtagccggatcgagctgggagatgtgacacc

SEQ ID NO: 2481 - DNA, 50 bp, Artificial Sequence; identical to SEQ ID NO: 2480
  Description of Artificial Sequence: Synthetic oligonucleotide

SEQ ID NO: 2482 - DNA, 50 bp, Artificial Sequence; identical to SEQ ID NO: 2480
  Description of Artificial Sequence: Synthetic oligonucleotide

SEQ ID NO: 2483 - DNA, 50 bp, Artificial Sequence
  Description of Artificial Sequence: Synthetic oligonucleotide
ggcggggaagatgaaaggtagccgaatcgagctgggagatgtgacaccac

SEQ ID NO: 2484 - DNA, 50 bp, Artificial Sequence
  Description of Artificial Sequence: Synthetic oligonucleotide
ggcggggaagatgaaaggtagccggatcgagctgggagatgtgacaccac

SEQ ID NO: 2485 - DNA, 50 bp, Artificial Sequence
  Description of Artificial Sequence: Synthetic oligonucleotide
gcggggaagatgaaaggtagccggatcgagctgggagatgtgacaccaca

SEQ ID NO: 2486 - DNA, 50 bp, Artificial Sequence; identical to SEQ ID NO: 2485
  Description of Artificial Sequence: Synthetic oligonucleotide

SEQ ID NO: 2487 - DNA, 50 bp, Artificial Sequence
  Description of Artificial Sequence: Synthetic oligonucleotide
ggggaagatgaaaggtagccggatcgagctgggagatgtgacaccacaca

SEQ ID NO: 2488 - DNA, 50 bp, Artificial Sequence; identical to SEQ ID NO: 2487
  Description of Artificial Sequence: Synthetic oligonucleotide

SEQ ID NO: 2489 - DNA, 50 bp, Artificial Sequence; identical to SEQ ID NO: 2487
  Description of Artificial Sequence: Synthetic oligonucleotide

SEQ ID NO: 2490 - DNA, 49 bp, Artificial Sequence
  Description of Artificial Sequence: Synthetic oligonucleotide
ggggaagatgaaaggtagccggatcgagctgggagatgtgacaccacac

SEQ ID NO: 2491 - DNA, 49 bp, Artificial Sequence; identical to SEQ ID NO: 2490
  Description of Artificial Sequence: Synthetic oligonucleotide

SEQ ID NO: 2492 - DNA, 50 bp, Artificial Sequence; identical to SEQ ID NO: 2487
  Description of Artificial Sequence: Synthetic oligonucleotide

SEQ ID NO: 2493 - DNA, 49 bp, Artificial Sequence; identical to SEQ ID NO: 2490
  Description of Artificial Sequence: Synthetic oligonucleotide

SEQ ID NO: 2494 - DNA, 49 bp, Artificial Sequence; identical to SEQ ID NO: 2490
  Description of Artificial Sequence: Synthetic oligonucleotide

SEQ ID NO: 2495 - DNA, 50 bp, Artificial Sequence; identical to SEQ ID NO: 2487
  Description of Artificial Sequence: Synthetic oligonucleotide

SEQ ID NO: 2496 - DNA, 100 bp, Artificial Sequence
  Description of Artificial Sequence: Synthetic polynucleotide
tcctgaccccgtacctgctggggccggacaagaacctgaccgagagggaggtacgcgcggcggacgcggggcgcgggaagggcgggcgaccggcctgcgg

SEQ ID NO: 2497 - DNA, 100 bp, Artificial Sequence
  Description of Artificial Sequence: Synthetic polynucleotide
aacaaatggggctaattatgttttattgagtacattttgatttgttccagtagccggatcgagctgggagatgtgacaccacacaatattaaacagttga

SEQ ID NO: 2498 - DNA, 50 bp, Artificial Sequence
  Description of Artificial Sequence: Synthetic oligonucleotide
ggggctaattatgttttattgagtacattttgatttgttccagtagccgg

SEQ ID NO: 2499 - DNA, 50 bp, Artificial Sequence; identical to SEQ ID NO: 2498
  Description of Artificial Sequence: Synthetic oligonucleotide

SEQ ID NO: 2500 - DNA, 50 bp, Artificial Sequence; identical to SEQ ID NO: 2498
  Description of Artificial Sequence: Synthetic oligonucleotide

SEQ ID NO: 2501 - DNA, 50 bp, Artificial Sequence; identical to SEQ ID NO: 2498
  Description of Artificial Sequence: Synthetic oligonucleotide

SEQ ID NO: 2502 - DNA, 50 bp, Artificial Sequence
  Description of Artificial Sequence: Synthetic oligonucleotide
tgttttattgagtacattttgatttgttccagtagccggatcgagcgggg

SEQ ID NO: 2503 - DNA, 100 bp, Artificial Sequence
  Description of Artificial Sequence: Synthetic polynucleotide
ccactcggccctgcgccgcgacaagtacgtggccgagttcctcgagtggggtgtttgaggaactgtggaagagggaaggcaagactccagggcagattgt

SEQ ID NO: 2504 - DNA, 50 bp, Artificial Sequence
  Description of Artificial Sequence: Synthetic oligonucleotide
tggccgagttcctcgagtggggtgtttgaggaactgtggaagagggaagg

SEQ ID NO: 2505 - DNA, 50 bp, Artificial Sequence; identical to SEQ ID NO: 2504
  Description of Artificial Sequence: Synthetic oligonucleotide

SEQ ID NO: 2506 - DNA, 100 bp, Artificial Sequence
  Description of Artificial Sequence: Synthetic polynucleotide
ccactcggccctgcgccgcgacaagtacgtggccgagttcctcgagtgggctaaaccatttacacagctggtgaaagaaatgcagcttcatcgagaagac

SEQ ID NO: 2507 - DNA, 49 bp, Artificial Sequence
  Description of Artificial Sequence: Synthetic oligonucleotide
gtggccgagttcctcgagtgggctaaaccatttacacagctggtgaaag

SEQ ID NO: 2508 - DNA, 49 bp, Artificial Sequence; identical to SEQ ID NO: 2507
  Description of Artificial Sequence: Synthetic oligonucleotide

SEQ ID NO: 2509 - DNA, 49 bp, Artificial Sequence; identical to SEQ ID NO: 2507
  Description of Artificial Sequence: Synthetic oligonucleotide

SEQ ID NO: 2510 - DNA, 50 bp, Artificial Sequence
  Description of Artificial Sequence: Synthetic oligonucleotide
ggccgagttcctcgagtgggctaaaccatttacacagctggtgaaagaaa

SEQ ID NO: 2511 - DNA, 50 bp, Artificial Sequence; identical to SEQ ID NO: 2510
  Description of Artificial Sequence: Synthetic oligonucleotide

SEQ ID NO: 2512 - DNA, 50 bp, Artificial Sequence
  Description of Artificial Sequence: Synthetic oligonucleotide
cgagtgggctaaaccatttacacagctggtgaaagaaatgcagcttcatc

SEQ ID NO: 2513 - DNA, 50 bp, Artificial Sequence; identical to SEQ ID NO: 2512
  Description of Artificial Sequence: Synthetic oligonucleotide

SEQ ID NO: 2514 - DNA, 50 bp, Artificial Sequence
  Description of Artificial Sequence: Synthetic oligonucleotide
gagtgggctaaaccatttacacagctggtgaaagaaatgcagcttcatcg

SEQ ID NO: 2515 - DNA, 50 bp, Artificial Sequence; identical to SEQ ID NO: 2514
  Description of Artificial Sequence: Synthetic oligonucleotide

SEQ ID NO: 2516 - DNA, 50 bp, Artificial Sequence; identical to SEQ ID NO: 2514
  Description of Artificial Sequence: Synthetic oligonucleotide

SEQ ID NO: 2517 - DNA, 50 bp, Artificial Sequence; identical to SEQ ID NO: 2514
  Description of Artificial Sequence: Synthetic oligonucleotide

SEQ ID NO: 2518 - DNA, 50 bp, Artificial Sequence; identical to SEQ ID NO: 2514
  Description of Artificial Sequence: Synthetic oligonucleotide

SEQ ID NO: 2519 - DNA, 50 bp, Artificial Sequence; identical to SEQ ID NO: 2514
  Description of Artificial Sequence: Synthetic oligonucleotide

SEQ ID NO: 2520 - DNA, 50 bp, Artificial Sequence
  Description of Artificial Sequence: Synthetic oligonucleotide
agtgggctaaaccatttacacagctggtgaaagaaatgcagcttcatcga

SEQ ID NO: 2521 - DNA, 50 bp, Artificial Sequence; identical to SEQ ID NO: 2520
  Description of Artificial Sequence: Synthetic oligonucleotide

SEQ ID NO: 2522 - DNA, 50 bp, Artificial Sequence; identical to SEQ ID NO: 2520
  Description of Artificial Sequence: Synthetic oligonucleotide

SEQ ID NO: 2523 - DNA, 50 bp, Artificial Sequence; identical to SEQ ID NO: 2520
  Description of Artificial Sequence: Synthetic oligonucleotide

SEQ ID NO: 2524 - DNA, 50 bp, Artificial Sequence; identical to SEQ ID NO: 2520
  Description of Artificial Sequence: Synthetic oligonucleotide

SEQ ID NO: 2525 - DNA, 50 bp, Artificial Sequence; identical to SEQ ID NO: 2520
  Description of Artificial Sequence: Synthetic oligonucleotide

SEQ ID NO: 2526 - DNA, 49 bp, Artificial Sequence
  Description of Artificial Sequence: Synthetic oligonucleotide
agtgggctaaaccatttacacagctggtgaaagaaatgcagcttcatcg

SEQ ID NO: 2527 - DNA, 50 bp, Artificial Sequence; identical to SEQ ID NO: 2520
  Description of Artificial Sequence: Synthetic oligonucleotide

SEQ ID NO: 2528 - DNA, 100 bp, Artificial Sequence
  Description of Artificial Sequence: Synthetic polynucleotide
ttcttgacctgctggacagcagaacaatttcttcatcagcagctaaacaggtgtttgaggaactgtggaagagggaaggcaagactccagggcagattgt

SEQ ID NO: 2529 - DNA, 100 bp, Artificial Sequence
  Description of Artificial Sequence: Synthetic polynucleotide
ccactcggccctgcgccgcgacaagtacgtggccgagttcctcgagtggggtaagtgcgcgccggcagggccggacctgcggctctgcgacccccgcgcc

SEQ ID NO: 2530 - DNA, 100 bp, Artificial Sequence
  Description of Artificial Sequence: Synthetic polynucleotide
agaagagctgacttctcatttctctttcctctcccttctctggtccataggtgtttgaggaactgtggaagagggaaggcaagactccagggcagattgt

SEQ ID NO: 2531 - DNA, 100 bp, Artificial Sequence
  Description of Artificial Sequence: Synthetic polynucleotide
tgggaggattgcattcagtctagttcctggttgccggctgaaataacctgttaatgattttcgcagtgtttccttgaacttgctacagacacattttaag

SEQ ID NO: 2532 - DNA, 50 bp, Artificial Sequence
  Description of Artificial Sequence: Synthetic oligonucleotide
tgccggctgaaataacctgttaatgattttcgcagtgtttccttgaactt

SEQ ID NO: 2533 - DNA, 100 bp, Artificial Sequence
  Description of Artificial Sequence: Synthetic polynucleotide
tgggaggattgcattcagtctagttcctggttgccggctgaaataacctgaattcaagccaggaagaagcagcaatctgtcttctggattaaaactgaag

SEQ ID NO: 2534 - DNA, 50 bp, Artificial Sequence
  Description of Artificial Sequence: Synthetic oligonucleotide
ttcctggttgccggctgaaataacctgaattcaagccaggatgaagcagc

SEQ ID NO: 2535 - DNA, 50 bp, Artificial Sequence; identical to SEQ ID NO: 2534
  Description of Artificial Sequence: Synthetic oligonucleotide

SEQ ID NO: 2536 - DNA, 50 bp, Artificial Sequence; identical to SEQ ID NO: 2534
  Description of Artificial Sequence: Synthetic oligonucleotide

SEQ ID NO: 2537 - DNA, 50 bp, Artificial Sequence
  Description of Artificial Sequence: Synthetic oligonucleotide
ggttgccggctgaaataacctgaattcaagccaggaagaagcagcaatct

SEQ ID NO: 2538 - DNA, 50 bp, Artificial Sequence; identical to SEQ ID NO: 2537
  Description of Artificial Sequence: Synthetic oligonucleotide

SEQ ID NO: 2539 - DNA, 50 bp, Artificial Sequence; identical to SEQ ID NO: 2537
  Description of Artificial Sequence: Synthetic oligonucleotide

SEQ ID NO: 2540 - DNA, 50 bp, Artificial Sequence; identical to SEQ ID NO: 2537
  Description of Artificial Sequence: Synthetic oligonucleotide

SEQ ID NO: 2541 - DNA, 50 bp, Artificial Sequence; identical to SEQ ID NO: 2537
  Description of Artificial Sequence: Synthetic oligonucleotide

SEQ ID NO: 2542 - DNA, 50 bp, Artificial Sequence; identical to SEQ ID NO: 2537
  Description of Artificial Sequence: Synthetic oligonucleotide

SEQ ID NO: 2543 - DNA, 50 bp, Artificial Sequence; identical to SEQ ID NO: 2537
  Description of Artificial Sequence: Synthetic oligonucleotide

SEQ ID NO: 2544 - DNA, 50 bp, Artificial Sequence; identical to SEQ ID NO: 2537
  Description of Artificial Sequence: Synthetic oligonucleotide

SEQ ID NO: 2545 - DNA, 50 bp, Artificial Sequence; identical to SEQ ID NO: 2537
  Description of Artificial Sequence: Synthetic oligonucleotide

SEQ ID NO: 2546 - DNA, 50 bp, Artificial Sequence; identical to SEQ ID NO: 2537
  Description of Artificial Sequence: Synthetic oligonucleotide

SEQ ID NO: 2547 - DNA, 50 bp, Artificial Sequence; identical to SEQ ID NO: 2537
  Description of Artificial Sequence: Synthetic oligonucleotide

SEQ ID NO: 2548 - DNA, 49 bp, Artificial Sequence
  Description of Artificial Sequence: Synthetic oligonucleotide
gttgccggctgaaataacctgaattcaagccaggaagaagcagcaatct

SEQ ID NO: 2549 - DNA, 50 bp, Artificial Sequence
  Description of Artificial Sequence: Synthetic oligonucleotide
gttgccggctgaaataacctgaattcaagccaggaagaagcagcaatctg

SEQ ID NO: 2550 - DNA, 49 bp, Artificial Sequence; identical to SEQ ID NO: 2548
  Description of Artificial Sequence: Synthetic oligonucleotide

SEQ ID NO: 2551 - DNA, 49 bp, Artificial Sequence; identical to SEQ ID NO: 2548
  Description of Artificial Sequence: Synthetic oligonucleotide

SEQ ID NO: 2552 - DNA, 49 bp, Artificial Sequence; identical to SEQ ID NO: 2548
  Description of Artificial Sequence: Synthetic oligonucleotide

SEQ ID NO: 2553 - DNA, 49 bp, Artificial Sequence; identical to SEQ ID NO: 2548
  Description of Artificial Sequence: Synthetic oligonucleotide

SEQ ID NO: 2554 - DNA, 50 bp, Artificial Sequence; identical to SEQ ID NO: 2549
  Description of Artificial Sequence: Synthetic oligonucleotide

SEQ ID NO: 2555 - DNA, 49 bp, Artificial Sequence; identical to SEQ ID NO: 2548
  Description of Artificial Sequence: Synthetic oligonucleotide

SEQ ID NO: 2556 - DNA, 49 bp, Artificial Sequence; identical to SEQ ID NO: 2548
  Description of Artificial Sequence: Synthetic oligonucleotide

SEQ ID NO: 2557 - DNA, 49 bp, Artificial Sequence; identical to SEQ ID NO: 2548
  Description of Artificial Sequence: Synthetic oligonucleotide

SEQ ID NO: 2558 - DNA, 49 bp, Artificial Sequence; identical to SEQ ID NO: 2548
  Description of Artificial Sequence: Synthetic oligonucleotide

SEQ ID NO: 2559 - DNA, 49 bp, Artificial Sequence; identical to SEQ ID NO: 2548
  Description of Artificial Sequence: Synthetic oligonucleotide

SEQ ID NO: 2560 - DNA, 50 bp, Artificial Sequence
  Description of Artificial Sequence: Synthetic oligonucleotide
tgccggctgaaataacctgaattcgagccaggaagaagcagcaatctgtc

SEQ ID NO: 2561 - DNA, 50 bp, Artificial Sequence; identical to SEQ ID NO: 2560
  Description of Artificial Sequence: Synthetic oligonucleotide

SEQ ID NO: 2562 - DNA, 50 bp, Artificial Sequence
  Description of Artificial Sequence: Synthetic oligonucleotide
tgccggctgaaataacctgaattcaagccaggaagaagcagcaatctgtc

SEQ ID NO: 2563 - DNA, 50 bp, Artificial Sequence; identical to SEQ ID NO: 2562
  Description of Artificial Sequence: Synthetic oligonucleotide

SEQ ID NO: 2564 - DNA, 50 bp, Artificial Sequence
  Description of Artificial Sequence: Synthetic oligonucleotide
gccggctgaaataacctgaattcaagccaggaagaagcagcaatctgtct

SEQ ID NO: 2565 - DNA, 50 bp, Artificial Sequence
  Description of Artificial Sequence: Synthetic oligonucleotide
gaaataacctgaattcaagccaggaagaagcagcaatctgtcttctggat

SEQ ID NO: 2566 - DNA, 50 bp, Artificial Sequence; identical to SEQ ID NO: 2565
  Description of Artificial Sequence: Synthetic oligonucleotide

SEQ ID NO: 2567 - DNA, 50 bp, Artificial Sequence; identical to SEQ ID NO: 2565
  Description of Artificial Sequence: Synthetic oligonucleotide

SEQ ID NO: 2568 - DNA, 50 bp, Artificial Sequence; identical to SEQ ID NO: 2565
  Description of Artificial Sequence: Synthetic oligonucleotide

SEQ ID NO: 2569 - DNA, 50 bp, Artificial Sequence
  Description of Artificial Sequence: Synthetic oligonucleotide
gaaataacctgaattcaagccaggaggaagcagcaatctgtcttctggat

SEQ ID NO: 2570 - DNA, 100 bp, Artificial Sequence
  Description of Artificial Sequence: Synthetic polynucleotide
tgggattggaccagcttgtgatctccgctttcgaagcattgtacagtgtgttaatgattttcgcagtgtttccttgaacttgctacagacacattttaag

SEQ ID NO: 2571 - DNA, 100 bp, Artificial Sequence
  Description of Artificial Sequence: Synthetic polynucleotide
tgggaggattgcattcagtctagttcctggttgccggctgaaataacctggtaagtggaactctgtaaggggctttgaaattggggtttaatcctatctc

SEQ ID NO: 2572 - DNA, 50 bp, Artificial Sequence
  Description of Artificial Sequence: Synthetic oligonucleotide
cctggttgccggctgaaataacctggtaagtggaactctgtaaggggctt

SEQ ID NO: 2573 - DNA, 50 bp, Artificial Sequence; identical to SEQ ID NO: 2572
  Description of Artificial Sequence: Synthetic oligonucleotide

SEQ ID NO: 2574 - DNA, 50 bp, Artificial Sequence; identical to SEQ ID NO: 2572
  Description of Artificial Sequence: Synthetic oligonucleotide

SEQ ID NO: 2575 - DNA, 50 bp, Artificial Sequence; identical to SEQ ID NO: 2572
  Description of Artificial Sequence: Synthetic oligonucleotide

SEQ ID NO: 2576 - DNA, 49 bp, Artificial Sequence
  Description of Artificial Sequence: Synthetic oligonucleotide
ccggctgaaataacctggtaagtggaactctgtaaggggctttgaaatt

SEQ ID NO: 2577 - DNA, 49 bp, Artificial Sequence; identical to SEQ ID NO: 2576
  Description of Artificial Sequence: Synthetic oligonucleotide

SEQ ID NO: 2578 - DNA, 100 bp, Artificial Sequence
  Description of Artificial Sequence: Synthetic polynucleotide
tacagatttgttacttcattgttgatgcataagttaattttcttttccagttaatgattttcgcagtgtttccttgaacttgctacagacacattttaag

SEQ ID NO: 2579 - DNA, 100 bp, Artificial Sequence
  Description of Artificial Sequence: Synthetic polynucleotide
tgacagcaagaggcaaaacttcggacatagaggccaaccaacctttggagcggacaaggcaaaatctcagcaagttcggacctctagtacaataaggcga

SEQ ID NO: 2580 - DNA, 50 bp, Artificial Sequence
  Description of Artificial Sequence: Synthetic oligonucleotide
caaccaacctttggagcggacaaggcaaaatctcagcaagttcggacctc

SEQ ID NO: 2581 - DNA, 100 bp, Artificial Sequence
  Description of Artificial Sequence: Synthetic polynucleotide
tgacagcaagaggcaaaacttcggacatagaggccaaccaacctttggagaccaacaaagaaaattcatccagtgtgactgtatcagaccctgagatgga

SEQ ID NO: 2582 - DNA, 100 bp, Artificial Sequence
  Description of Artificial Sequence: Synthetic polynucleotide
gaggagcagctcacctgagagacggagccccggctcgcccgtgtgcagagcggacaaggcaaaatctcagcaagttcggacctctagtacaataaggcga

SEQ ID NO: 2583 - DNA, 100 bp, Artificial Sequence
  Description of Artificial Sequence: Synthetic polynucleotide
tgacagcaagaggcaaaacttcggacatagaggccaaccaacctttggaggtaagtgaaacagagtaagtccttttcggtgaaactgaacaagtcactat

SEQ ID NO: 2584 - DNA, 100 bp, Artificial Sequence
  Description of Artificial Sequence: Synthetic polynucleotide
aaattttattttattcactaatgactaatcttttttttcactttctgtagcggacaaggcaaaatctcagcaagttcggacctctagtacaataaggcga

SEQ ID NO: 2585 - DNA, 100 bp, Artificial Sequence
  Description of Artificial Sequence: Synthetic polynucleotide
tggccccaggtgtaagcgcagaaagcaggcgaacccgcggcgcaataacggctattagtgaaagatggtggatcgcttggcaaacagtgaagcaaatact

SEQ ID NO: 2586 - DNA, 50 bp, Artificial Sequence
  Description of Artificial Sequence: Synthetic oligonucleotide
agcaggcgaacccgcggcgcaataacggctattagggaaagatggtggat

SEQ ID NO: 2587 - DNA, 47 bp, Artificial Sequence
  Description of Artificial Sequence: Synthetic oligonucleotide
aggcgaacccgcggcgcaataacggctattagtgaaagatggtggat

SEQ ID NO: 2588 - DNA, 100 bp, Artificial Sequence
  Description of Artificial Sequence: Synthetic polynucleotide
tggccccaggtgtaagcgcagaaagcaggcgaacccgcggcgcaataacgttacaaattataatactgtggtagaaacaaattcagattcagatgatgaa

SEQ ID NO: 2589 - DNA, 50 bp, Artificial Sequence
  Description of Artificial Sequence: Synthetic oligonucleotide
gcaggcgaacccgcggcgcaataacgttacaaattataatactgtggtag

SEQ ID NO: 2590 - DNA, 50 bp, Artificial Sequence
  Description of Artificial Sequence: Synthetic oligonucleotide
caggcgaacccgcggcgcaataacgttacaaattataatacagtggtaga

SEQ ID NO: 2591 - DNA, 50 bp, Artificial Sequence
  Description of Artificial Sequence: Synthetic oligonucleotide
cgcggcgcaataacgttacaaattataatactgtggtagaaacaaattca

SEQ ID NO: 2592 - DNA, 50 bp, Artificial Sequence; identical to SEQ ID NO: 2591
  Description of Artificial Sequence: Synthetic oligonucleotide

SEQ ID NO: 2593 - DNA, 50 bp, Artificial Sequence
  Description of Artificial Sequence: Synthetic oligonucleotide
cgcggcgcaataacgttacaaactataatactgtggtagaaacaaattca

SEQ ID NO: 2594 - DNA, 50 bp, Artificial Sequence
  Description of Artificial Sequence: Synthetic oligonucleotide
gcggcgcaataacgttacaaattataatactgtggtagaaacaaattcag

SEQ ID NO: 2595 - DNA, 50 bp, Artificial Sequence; identical to SEQ ID NO: 2594
  Description of Artificial Sequence: Synthetic oligonucleotide

SEQ ID NO: 2596 - DNA, 100 bp, Artificial Sequence
  Description of Artificial Sequence: Synthetic polynucleotide
tcggaccttcgccttcgctgtcgccgccgccgccgcccgcggccgtcggggctattagtgaaagatggtggatcgcttggcaaacagtgaagcaaatact

SEQ ID NO: 2597 - DNA, 100 bp, Artificial Sequence
  Description of Artificial Sequence: Synthetic polynucleotide
tggccccaggtgtaagcgcagaaagcaggcgaacccgcggcgcaataacggtgagtggcggaggggaccggggagcggcggagtcagggggagctgggca

SEQ ID NO: 2598 - DNA, 100 bp, Artificial Sequence
  Description of Artificial Sequence: Synthetic polynucleotide
taggaatttataatttatatgtgctaatttctttttcttttttttaaaaggctattagtgaaagatggtggatcgcttggcaaacagtgaagcaaatact

SEQ ID NO: 2599 - DNA, 100 bp, Artificial Sequence
  Description of Artificial Sequence: Synthetic polynucleotide
gaactgaacaaagacaacattgttcctggaacgccctctttttaaaaaagattctcataaacacaaagataaacacaaagatcgagaacaccggcacaaa

SEQ ID NO: 2600 - DNA, 50 bp, Artificial Sequence
  Description of Artificial Sequence: Synthetic oligonucleotide
acattgttcctggaacgccctctttttaaaaaagattctcataagcacaa

SEQ ID NO: 2601 - DNA, 50 bp, Artificial Sequence; identical to SEQ ID NO: 2600
  Description of Artificial Sequence: Synthetic oligonucleotide

SEQ ID NO: 2602 - DNA, 50 bp, Artificial Sequence; identical to SEQ ID NO: 2600
  Description of Artificial Sequence: Synthetic oligonucleotide

SEQ ID NO: 2603 - DNA, 50 bp, Artificial Sequence; identical to SEQ ID NO: 2600
  Description of Artificial Sequence: Synthetic oligonucleotide

SEQ ID NO: 2604 - DNA, 50 bp, Artificial Sequence; identical to SEQ ID NO: 2600
  Description of Artificial Sequence: Synthetic oligonucleotide

SEQ ID NO: 2605 - DNA, 50 bp, Artificial Sequence; identical to SEQ ID NO: 2600
  Description of Artificial Sequence: Synthetic oligonucleotide

SEQ ID NO: 2606 - DNA, 47 bp, Artificial Sequence
  Description of Artificial Sequence: Synthetic oligonucleotide
tggaacgccctctttttaaaaaagattctcataaacacaaagataaa

SEQ ID NO: 2607 - DNA, 47 bp, Artificial Sequence; identical to SEQ ID NO: 2606
  Description of Artificial Sequence: Synthetic oligonucleotide

SEQ ID NO: 2608 - DNA, 47 bp, Artificial Sequence; identical to SEQ ID NO: 2606
  Description of Artificial Sequence: Synthetic oligonucleotide

SEQ ID NO: 2609 - DNA, 47 bp, Artificial Sequence; identical to SEQ ID NO: 2606
  Description of Artificial Sequence: Synthetic oligonucleotide

SEQ ID NO: 2610 - DNA, 47 bp, Artificial Sequence; identical to SEQ ID NO: 2606
  Description of Artificial Sequence: Synthetic oligonucleotide

SEQ ID NO: 2611 - DNA, 47 bp, Artificial Sequence; identical to SEQ ID NO: 2606
  Description of Artificial Sequence: Synthetic oligonucleotide

SEQ ID NO: 2612 - DNA, 47 bp, Artificial Sequence; identical to SEQ ID NO: 2606
  Description of Artificial Sequence: Synthetic oligonucleotide

SEQ ID NO: 2613 - DNA, 47 bp, Artificial Sequence; identical to SEQ ID NO: 2606
  Description of Artificial Sequence: Synthetic oligonucleotide

SEQ ID NO: 2614 - DNA, 47 bp, Artificial Sequence; identical to SEQ ID NO: 2606
  Description of Artificial Sequence: Synthetic oligonucleotide

SEQ ID NO: 2615 - DNA, 100 bp, Artificial Sequence
  Description of Artificial Sequence: Synthetic polynucleotide
gaactgaacaaagacaacattgttcctggaacgccctctttttaaaaaagaaagcataacccctactgtagaactaaatgcactgtgcatgaaacttgga

SEQ ID NO: 2616 - DNA, 47 bp, Artificial Sequence
  Description of Artificial Sequence: Synthetic oligonucleotide
ggaacgccctctttttaaaaaagaaagcataacccctactgtagaac

SEQ ID NO: 2617 - DNA, 47 bp, Artificial Sequence; identical to SEQ ID NO: 2616
  Description of Artificial Sequence: Synthetic oligonucleotide

SEQ ID NO: 2618 - DNA, 100 bp, Artificial Sequence
  Description of Artificial Sequence: Synthetic polynucleotide
ggaccacctccacaacgattcccagatcgaagcggatttccgattgaatgattctcataaacacaaagataaacacaaagatcgagaacaccggcacaaa

SEQ ID NO: 2619 - DNA, 100 bp, Artificial Sequence
  Description of Artificial Sequence: Synthetic polynucleotide
gaactgaacaaagacaacattgttcctggaacgccctctttttaaaaaaggtacatataatttggctttataatttctggcctgttgataatcagtggta

SEQ ID NO: 2620 - DNA, 50 bp, Artificial Sequence
  Description of Artificial Sequence: Synthetic oligonucleotide
ggaacgccctctttttaaaaaaggtacatataatttggctttataatttc

SEQ ID NO: 2621 - DNA, 50 bp, Artificial Sequence; identical to SEQ ID NO: 2620
  Description of Artificial Sequence: Synthetic oligonucleotide

SEQ ID NO: 2622 - DNA, 50 bp, Artificial Sequence; identical to SEQ ID NO: 2620
  Description of Artificial Sequence: Synthetic oligonucleotide

SEQ ID NO: 2623 - DNA, 50 bp, Artificial Sequence; identical to SEQ ID NO: 2620
  Description of Artificial Sequence: Synthetic oligonucleotide

SEQ ID NO: 2624 - DNA, 50 bp, Artificial Sequence; identical to SEQ ID NO: 2620
  Description of Artificial Sequence: Synthetic oligonucleotide

SEQ ID NO: 2625 - DNA, 50 bp, Artificial Sequence; identical to SEQ ID NO: 2620
  Description of Artificial Sequence: Synthetic oligonucleotide

SEQ ID NO: 2626 - DNA, 50 bp, Artificial Sequence; identical to SEQ ID NO: 2620
  Description of Artificial Sequence: Synthetic oligonucleotide

SEQ ID NO: 2627 - DNA, 50 bp, Artificial Sequence; identical to SEQ ID NO: 2620
  Description of Artificial Sequence: Synthetic oligonucleotide

SEQ ID NO: 2628 - DNA, 50 bp, Artificial Sequence; identical to SEQ ID NO: 2620
  Description of Artificial Sequence: Synthetic oligonucleotide

SEQ ID NO: 2629 - DNA, 100 bp, Artificial Sequence
  Description of Artificial Sequence: Synthetic polynucleotide
agaagatagctcatgactcctgttaactgactcatctcttatggttgcagattctcataaacacaaagataaacacaaagatcgagaacaccggcacaaa

SEQ ID NO: 2630 - DNA, 100 bp, Artificial Sequence
  Description of Artificial Sequence: Synthetic polynucleotide
gccttctttggctacacagtgcagcagcacgacatcagtggcaataagtggaatgtagtaagaaaacaaaaactgatgaccaagagaatgtgtcagccga

SEQ ID NO: 2631 - DNA, 50 bp, Artificial Sequence
  Description of Artificial Sequence: Synthetic oligonucleotide
gcagcacgacatcagtggcaataagtggaatgtagtaagaaaacaaaaac

SEQ ID NO: 2632 - DNA, 50 bp, Artificial Sequence; identical to SEQ ID NO: 2631
  Description of Artificial Sequence: Synthetic oligonucleotide

SEQ ID NO: 2633 - DNA, 50 bp, Artificial Sequence; identical to SEQ ID NO: 2631
  Description of Artificial Sequence: Synthetic oligonucleotide

SEQ ID NO: 2634 - DNA, 50 bp, Artificial Sequence; identical to SEQ ID NO: 2631
  Description of Artificial Sequence: Synthetic oligonucleotide

SEQ ID NO: 2635 - DNA, 50 bp, Artificial Sequence; identical to SEQ ID NO: 2631
  Description of Artificial Sequence: Synthetic oligonucleotide

SEQ ID NO: 2636 - DNA, 50 bp, Artificial Sequence; identical to SEQ ID NO: 2631
  Description of Artificial Sequence: Synthetic oligonucleotide

SEQ ID NO: 2637 - DNA, 50 bp, Artificial Sequence; identical to SEQ ID NO: 2631
  Description of Artificial Sequence: Synthetic oligonucleotide

SEQ ID NO: 2638 - DNA, 100 bp, Artificial Sequence
  Description of Artificial Sequence: Synthetic polynucleotide
gccttctttggctacacagtgcagcagcacgacatcagtggcaataagtggctggtcgtgggcgccccactggaaaccaatggctaccagaagacgggag

SEQ ID NO: 2639 - DNA, 100 bp, Artificial Sequence
  Description of Artificial Sequence: Synthetic polynucleotide
gcctcccgcccgccgcgctccagatgaagtgtgagcactgcacgcgcaaggaatgtagtaagaaaacaaaaactgatgaccaagagaatgtgtcagccga

SEQ ID NO: 2640 - DNA, 100 bp, Artificial Sequence
  Description of Artificial Sequence: Synthetic polynucleotide
gccttctttggctacacagtgcagcagcacgacatcagtggcaataagtggtgagtgagagcggccgcccacacccagccctgtaccattccacacccag

SEQ ID NO: 2641 - DNA, 100 bp, Artificial Sequence
  Description of Artificial Sequence: Synthetic polynucleotide
aagggagacgaagtaaaagttcattgataatgttcctttgcttttttaaggaatgtagtaagaaaacaaaaactgatgaccaagagaatgtgtcagccga

SEQ ID NO: 2642 - DNA, 100 bp, Artificial Sequence
  Description of Artificial Sequence: Synthetic polynucleotide
ccatgatctcttccaaagaatgccacagaatcaggggaggcatgcttcagcactggaagacgcaacgcagtgaggagtatgaagcggaaggccagttaag

SEQ ID NO: 2643 - DNA, 50 bp, Artificial Sequence
  Description of Artificial Sequence: Synthetic oligonucleotide
caggggaggcatgcttcagcactggaagacgcaacgcagtgaggagtatg

SEQ ID NO: 2644 - DNA, 49 bp, Artificial Sequence
  Description of Artificial Sequence: Synthetic oligonucleotide
aggggaggcatgcttcagcactggaagacgcaacgcagtgaggagtatg

SEQ ID NO: 2645 - DNA, 49 bp, Artificial Sequence; identical to SEQ ID NO: 2644
  Description of Artificial Sequence: Synthetic oligonucleotide

SEQ ID NO: 2646 - DNA, 100 bp, Artificial Sequence
  Description of Artificial Sequence: Synthetic polynucleotide
ccatgatctcttccaaagaatgccacagaatcaggggaggcatgcttcaggtattgggagagttgctgctacatctttaggaaatttgactaaccatggt

SEQ ID NO: 2647 - DNA, 50 bp, Artificial Sequence
  Description of Artificial Sequence: Synthetic oligonucleotide
tcaggggaggcatgcttcaggtattgggagagttgctgctacatctttag

SEQ ID NO: 2648 - DNA, 50 bp, Artificial Sequence; identical to SEQ ID NO: 2647
  Description of Artificial Sequence: Synthetic oligonucleotide

SEQ ID NO: 2649 - DNA, 49 bp, Artificial Sequence
  Description of Artificial Sequence: Synthetic oligonucleotide
aggggaggcatgcttcaggtattgggagagttgctgctacatctttagg

SEQ ID NO: 2650 - DNA, 49 bp, Artificial Sequence; identical to SEQ ID NO: 2649
  Description of Artificial Sequence: Synthetic oligonucleotide

SEQ ID NO: 2651 - DNA, 49 bp, Artificial Sequence; identical to SEQ ID NO: 2649
  Description of Artificial Sequence: Synthetic oligonucleotide

SEQ ID NO: 2652 - DNA, 49 bp, Artificial Sequence; identical to SEQ ID NO: 2649
  Description of Artificial Sequence: Synthetic oligonucleotide

SEQ ID NO: 2653 - DNA, 49 bp, Artificial Sequence; identical to SEQ ID NO: 2649
  Description of Artificial Sequence: Synthetic oligonucleotide

SEQ ID NO: 2654 - DNA, 49 bp, Artificial Sequence; identical to SEQ ID NO: 2649
  Description of Artificial Sequence: Synthetic oligonucleotide

SEQ ID NO: 2655 - DNA, 50 bp, Artificial Sequence
  Description of Artificial Sequence: Synthetic oligonucleotide
ggggaggcatgcttcaggtattgggagagttgctgctacatctttaggaa

SEQ ID NO: 2656 - DNA, 50 bp, Artificial Sequence; identical to SEQ ID NO: 2655
  Description of Artificial Sequence: Synthetic oligonucleotide

SEQ ID NO: 2657 - DNA, 50 bp, Artificial Sequence
  Description of Artificial Sequence: Synthetic oligonucleotide
gggaggcatgcttcaggtattgggagagttgctgctacatctttaggaaa

SEQ ID NO: 2658 - DNA, 50 bp, Artificial Sequence; identical to SEQ ID NO: 2657
  Description of Artificial Sequence: Synthetic oligonucleotide

SEQ ID NO: 2659 - DNA, 50 bp, Artificial Sequence; identical to SEQ ID NO: 2657
  Description of Artificial Sequence: Synthetic oligonucleotide

SEQ ID NO: 2660 - DNA, 100 bp, Artificial Sequence
  Description of Artificial Sequence: Synthetic polynucleotide
tggatgaagaagcgcggccttcacacatcccagccggtgactgcagtgagcactggaagacgcaacgcagtgaggagtatgaagcggaaggccagttaag

SEQ ID NO: 2661 - DNA, 50 bp, Artificial Sequence
  Description of Artificial Sequence: Synthetic oligonucleotide
cagccggtgactgcagtgagcactggaagacgcaacgcagtgaggagtat

SEQ ID NO: 2662 - DNA, 50 bp, Artificial Sequence; identical to SEQ ID NO: 2661
  Description of Artificial Sequence: Synthetic oligonucleotide

SEQ ID NO: 2663 - DNA, 50 bp, Artificial Sequence; identical to SEQ ID NO: 2661
  Description of Artificial Sequence: Synthetic oligonucleotide

SEQ ID NO: 2664 - DNA, 50 bp, Artificial Sequence; identical to SEQ ID NO: 2661
  Description of Artificial Sequence: Synthetic oligonucleotide

SEQ ID NO: 2665 - DNA, 50 bp, Artificial Sequence; identical to SEQ ID NO: 2661
  Description of Artificial Sequence: Synthetic oligonucleotide

SEQ ID NO: 2666 - DNA, 50 bp, Artificial Sequence; identical to SEQ ID NO: 2661
  Description of Artificial Sequence: Synthetic oligonucleotide

SEQ ID NO: 2667 - DNA, 50 bp, Artificial Sequence; identical to SEQ ID NO: 2661
  Description of Artificial Sequence: Synthetic oligonucleotide

SEQ ID NO: 2668 - DNA, 100 bp, Artificial Sequence
  Description of Artificial Sequence: Synthetic polynucleotide
ccatgatctcttccaaagaatgccacagaatcaggggaggcatgcttcaggtagcttaacattataaataatatagtagtttatatttattgacatgtca

SEQ ID NO: 2669 - DNA, 100 bp, Artificial Sequence
  Description of Artificial Sequence: Synthetic polynucleotide
tctttctgaataagttctaaagcacactaatcttctcttgccttctctagcactggaagacgcaacgcagtgaggagtatgaagcggaaggtaagagccg

SEQ ID NO: 2670 - DNA, 100 bp, Artificial Sequence
  Description of Artificial Sequence: Synthetic polynucleotide
tggcctacagcttattatcgtcatcctgccggggaagacaccagtgtatgataattcctaccaacaaccttatggggaaaacgagtaccctctagtgaga

SEQ ID NO: 2671 - DNA, 50 bp, Artificial Sequence
  Description of Artificial Sequence: Synthetic oligonucleotide
gccggggaagacaccagtgtatgataattcctaccaacaaccttatgggg

SEQ ID NO: 2672 - DNA, 50 bp, Artificial Sequence; identical to SEQ ID NO: 2671
  Description of Artificial Sequence: Synthetic oligonucleotide

SEQ ID NO: 2673 - DNA, 50 bp, Artificial Sequence; identical to SEQ ID NO: 2671
  Description of Artificial Sequence: Synthetic oligonucleotide

SEQ ID NO: 2674 - DNA, 50 bp, Artificial Sequence
  Description of Artificial Sequence: Synthetic oligonucleotide
ggggaagacaccagtgtatgataattcctaccaacaaccttatggggaaa

SEQ ID NO: 2675 - DNA, 100 bp, Artificial Sequence
  Description of Artificial Sequence: Synthetic polynucleotide
tggcctacagcttattatcgtcatcctgccggggaagacaccagtgtatgcggaagtgaaacgtgtaggagacacacttttgggtatggctacacaatgt

SEQ ID NO: 2676 - DNA, 50 bp, Artificial Sequence
  Description of Artificial Sequence: Synthetic oligonucleotide
gccggggaagacaccagtgtatgcggaagtgaaacgtgtaggagacacac

SEQ ID NO: 2677 - DNA, 50 bp, Artificial Sequence; identical to SEQ ID NO: 2676
  Description of Artificial Sequence: Synthetic oligonucleotide

SEQ ID NO: 2678 - DNA, 50 bp, Artificial Sequence; identical to SEQ ID NO: 2676
  Description of Artificial Sequence: Synthetic oligonucleotide

SEQ ID NO: 2679 - DNA, 50 bp, Artificial Sequence; identical to SEQ ID NO: 2676
  Description of Artificial Sequence: Synthetic oligonucleotide

SEQ ID NO: 2680 - DNA, 100 bp, Artificial Sequence
  Description of Artificial Sequence: Synthetic polynucleotide
ggcctcagtgaagttgggtccatttaccttgatcctgcaaagctacccagataattcctaccaacaaccttatggggaaaacgagtaccctctagtgaga

SEQ ID NO: 2681 - DNA, 100 bp, Artificial Sequence
  Description of Artificial Sequence: Synthetic polynucleotide
tggcctacagcttattatcgtcatcctgccggggaagacaccagtgtatggtaaggatatcttaagactgcatttttcctcaagtacttgatgtcctttt

SEQ ID NO: 2682 - DNA, 100 bp, Artificial Sequence
  Description of Artificial Sequence: Synthetic polynucleotide
tatgaatctgtgttgcagccattaactacttgaataccattcaatttcagataattcctaccaacaaccttatggggaaaacgagtaccctctagtgaga

SEQ ID NO: 2683 - DNA, 100 bp, Artificial Sequence
  Description of Artificial Sequence: Synthetic polynucleotide
ccaggcctgcgcgggcccgaggccggaggaacccggactccggcgtagcgggccgatgtccattggaatcactgtgatgctgatcatacacaactatttg

SEQ ID NO: 2684 - DNA, 49 bp, Artificial Sequence
  Description of Artificial Sequence: Synthetic oligonucleotide
gccggaggaacccggactccggcgtagcgggccgatgtccattggaatc

SEQ ID NO: 2685 - DNA, 49 bp, Artificial Sequence; identical to SEQ ID NO: 2684
  Description of Artificial Sequence: Synthetic oligonucleotide

SEQ ID NO: 2686 - DNA, 49 bp, Artificial Sequence; identical to SEQ ID NO: 2684
  Description of Artificial Sequence: Synthetic oligonucleotide

SEQ ID NO: 2687 - DNA, 100 bp, Artificial Sequence
  Description of Artificial Sequence: Synthetic polynucleotide
ccaggcctgcgcgggcccgaggccggaggaacccggactccggcgtagcggttttgacacaagggcgcatatcttcaaagcacctagtacctcctaccat

SEQ ID NO: 2688 - DNA, 50 bp, Artificial Sequence
  Description of Artificial Sequence: Synthetic oligonucleotide
gactccggcgtagcggttttgacacaagggcgcatatcttcaaagcacct

SEQ ID NO: 2689 - DNA, 50 bp, Artificial Sequence
  Description of Artificial Sequence: Synthetic oligonucleotide
ccggcgtagcggttttgacacaagggcgcatatcttcaaagcacctagta

SEQ ID NO: 2690 - DNA, 50 bp, Artificial Sequence
  Description of Artificial Sequence: Synthetic oligonucleotide
gtagcggttttgacacaagggcgcatatcttcaaagcacctagtacctcc

SEQ ID NO: 2691 - DNA, 100 bp, Artificial Sequence
  Description of Artificial Sequence: Synthetic polynucleotide
gctgcagacggtggccgtgctgcagtgggtcctgaaatacctgctgctcgggccgatgtccattggaatcactgtgatgctgatcatacacaactatttg

SEQ ID NO: 2692 - DNA, 100 bp, Artificial Sequence
  Description of Artificial Sequence: Synthetic polynucleotide
ccaggcctgcgcgggcccgaggccggaggaacccggactccggcgtagcggtgagtgcggcgccggttgtgggagcggcgggagccggttggcggcgcgg

SEQ ID NO: 2693 - DNA, 100 bp, Artificial Sequence
  Description of Artificial Sequence: Synthetic polynucleotide
tgagcagatactaacagactgattccatgagactttttcttttcttacagggccgatgtccattggaatcactgtgatgctgatcatacacaactatttg

SEQ ID NO: 2694 - DNA, 100 bp, Artificial Sequence
  Description of Artificial Sequence: Synthetic polynucleotide
cggtactggagccaatcagcgcgggcagcgaaccgggggagcgaggcacggaacggtcactgcgcaggatcaagctacaatgaagaggagggaggcagtc

SEQ ID NO: 2695 - DNA, 50 bp, Artificial Sequence
  Description of Artificial Sequence: Synthetic oligonucleotide
cgcgggcagcgaaccgggggagcgaggcacggaacggtcactgcgcagga

SEQ ID NO: 2696 - DNA, 50 bp, Artificial Sequence
  Description of Artificial Sequence: Synthetic oligonucleotide
gggggagcgaggcacggaacggttactgcgcaggatcaagctacaatgaa

SEQ ID NO: 2697 - DNA, 100 bp, Artificial Sequence
  Description of Artificial Sequence: Synthetic polynucleotide
cggtactggagccaatcagcgcgggcagcgaaccgggggagcgaggcacggagtgtacctcacagccttctaggatctccagagtggacaggaatctcac

SEQ ID NO: 2698 - DNA, 100 bp, Artificial Sequence
  Description of Artificial Sequence: Synthetic polynucleotide
tccagcatttgtgccccggtccggcccctcccaggcctgactctttccgtgaacggtcactgcgcaggatcaagctacaatgaagaggagggaggcagtc

SEQ ID NO: 2699 - DNA, 100 bp, Artificial Sequence
  Description of Artificial Sequence: Synthetic polynucleotide
cggtactggagccaatcagcgcgggcagcgaaccgggggagcgaggcacggtgagtgtgaggagccaatatccagcggcccagagccggccccagcgccc

SEQ ID NO: 2700 - DNA, 50 bp, Artificial Sequence
  Description of Artificial Sequence: Synthetic oligonucleotide
aggcacggtgagtgtgaggagccaatatccagcggcccagagccggcccc

SEQ ID NO: 2701 - DNA, 100 bp, Artificial Sequence
  Description of Artificial Sequence: Synthetic polynucleotide
ttgtcttcctatgtatcaagtttcttctgatttttttttttcttttataggaacggtcactgcgcaggatcaagctacaatgaagaggagggaggcagtc

SEQ ID NO: 2702 - DNA, 100 bp, Artificial Sequence
  Description of Artificial Sequence: Synthetic polynucleotide
ggtgaccactccggagaacagttcctccccagggatgatggacatgcatgggagttgaacttgtcaaattaatgtctacagtgatatgtatgaaacaaag

SEQ ID NO: 2703 - DNA, 50 bp, Artificial Sequence
  Description of Artificial Sequence: Synthetic oligonucleotide
agggatgatggacatgcatgggagttgaacttgtcaaattaatgtctaca

SEQ ID NO: 2704 - DNA, 100 bp, Artificial Sequence
  Description of Artificial Sequence: Synthetic polynucleotide
ggtgaccactccggagaacagttcctccccagggatgatggacatgcatgacgataacagcaaccagagctccatcgcagatgcctcccccatcaaacag

SEQ ID NO: 2705 - DNA, 100 bp, Artificial Sequence
  Description of Artificial Sequence: Synthetic polynucleotide
gcggaggaggctgcgggcggcgccccgggatagggaccctgcagctccagggagttgaacttgtcaaattaatgtctacagtgatatgtatgaaacaaag

SEQ ID NO: 2706 - DNA, 100 bp, Artificial Sequence
  Description of Artificial Sequence: Synthetic polynucleotide
ggtgaccactccggagaacagttcctccccagggatgatggacatgcatggtgagtgcccatggcctgccagcctctcctgcccagcccggggccttggc

SEQ ID NO: 2707 - DNA, 100 bp, Artificial Sequence
  Description of Artificial Sequence: Synthetic polynucleotide
tcattgcatcattgtaaacctgctcttctttctccattctttgtttatagggagttgaacttgtcaaattaatgtctacagtgatatgtatgaaacaaag

SEQ ID NO: 2708 - DNA, 100 bp, Artificial Sequence
  Description of Artificial Sequence: Synthetic polynucleotide
cgccaccatctttcgggctgccgagggtgttcttgacgattaatcaacagtccaatatcagatggaaatgatgcggagccttcgccatgtaaacattgat

SEQ ID NO: 2709 - DNA, 50 bp, Artificial Sequence
  Description of Artificial Sequence: Synthetic oligonucleotide
ttcgggctgccgagggtgttcttgacgattaatcaacagtccaatatcag

SEQ ID NO: 2710 - DNA, 50 bp, Artificial Sequence; identical to SEQ ID NO: 2709
  Description of Artificial Sequence: Synthetic oligonucleotide

SEQ ID NO: 2711 - DNA, 50 bp, Artificial Sequence
  Description of Artificial Sequence: Synthetic oligonucleotide
cgggctgctgagggtgttcttgacgattaatcaacagtccaatatcagat

SEQ ID NO: 2712 - DNA, 50 bp, Artificial Sequence; identical to SEQ ID NO: 2711
  Description of Artificial Sequence: Synthetic oligonucleotide

SEQ ID NO: 2713 - DNA, 50 bp, Artificial Sequence; identical to SEQ ID NO: 2711
  Description of Artificial Sequence: Synthetic oligonucleotide

SEQ ID NO: 2714 - DNA, 50 bp, Artificial Sequence
  Description of Artificial Sequence: Synthetic oligonucleotide
ggctgccgagggtgttcttgacgattaatcaacagtccaatatcagatgg

SEQ ID NO: 2715 - DNA, 50 bp, Artificial Sequence; identical to SEQ ID NO: 2714
  Description of Artificial Sequence: Synthetic oligonucleotide

SEQ ID NO: 2716 - DNA, 50 bp, Artificial Sequence; identical to SEQ ID NO: 2714
  Description of Artificial Sequence: Synthetic oligonucleotide

SEQ ID NO: 2717 - DNA, 50 bp, Artificial Sequence; identical to SEQ ID NO: 2714
  Description of Artificial Sequence: Synthetic oligonucleotide

SEQ ID NO: 2718 - DNA, 50 bp, Artificial Sequence
  Description of Artificial Sequence: Synthetic oligonucleotide
gctgccgagggtgttcttgacgattaatcaacagtccaatatcagatgga

SEQ ID NO: 2719 - DNA, 50 bp, Artificial Sequence; identical to SEQ ID NO: 2718
  Description of Artificial Sequence: Synthetic oligonucleotide

SEQ ID NO: 2720 - DNA, 50 bp, Artificial Sequence; identical to SEQ ID NO: 2718
  Description of Artificial Sequence: Synthetic oligonucleotide

SEQ ID NO: 2721 - DNA, 50 bp, Artificial Sequence; identical to SEQ ID NO: 2718
  Description of Artificial Sequence: Synthetic oligonucleotide

SEQ ID NO: 2722 - DNA, 50 bp, Artificial Sequence; identical to SEQ ID NO: 2718
  Description of Artificial Sequence: Synthetic oligonucleotide

SEQ ID NO: 2723 - DNA, 50 bp, Artificial Sequence; identical to SEQ ID NO: 2718
  Description of Artificial Sequence: Synthetic oligonucleotide

SEQ ID NO: 2724 - DNA, 50 bp, Artificial Sequence; identical to SEQ ID NO: 2718
  Description of Artificial Sequence: Synthetic oligonucleotide

SEQ ID NO: 2725 - DNA, 50 bp, Artificial Sequence; identical to SEQ ID NO: 2718
  Description of Artificial Sequence: Synthetic oligonucleotide

SEQ ID NO: 2726 - DNA, 50 bp, Artificial Sequence; identical to SEQ ID NO: 2718
  Description of Artificial Sequence: Synthetic oligonucleotide

SEQ ID NO: 2727 - DNA, 50 bp, Artificial Sequence; identical to SEQ ID NO: 2718
  Description of Artificial Sequence: Synthetic oligonucleotide

SEQ ID NO: 2728 - DNA, 50 bp, Artificial Sequence; identical to SEQ ID NO: 2718
  Description of Artificial Sequence: Synthetic oligonucleotide

SEQ ID NO: 2729 - DNA, 50 bp, Artificial Sequence; identical to SEQ ID NO: 2718
  Description of Artificial Sequence: Synthetic oligonucleotide

SEQ ID NO: 2730 - DNA, 50 bp, Artificial Sequence; identical to SEQ ID NO: 2718
  Description of Artificial Sequence: Synthetic oligonucleotide

SEQ ID NO: 2731 - DNA, 50 bp, Artificial Sequence
  Description of Artificial Sequence: Synthetic oligonucleotide
gccgagggtgttcttgacgattaatcaacagtccaatatcagatggaaat

SEQ ID NO: 2732 - DNA, 50 bp, Artificial Sequence; identical to SEQ ID NO: 2731
  Description of Artificial Sequence: Synthetic oligonucleotide

SEQ ID NO: 2733 - DNA, 50 bp, Artificial Sequence; identical to SEQ ID NO: 2731
  Description of Artificial Sequence: Synthetic oligonucleotide

SEQ ID NO: 2734 - DNA, 50 bp, Artificial Sequence; identical to SEQ ID NO: 2731
  Description of Artificial Sequence: Synthetic oligonucleotide

SEQ ID NO: 2735 - DNA, 50 bp, Artificial Sequence; identical to SEQ ID NO: 2731
  Description of Artificial Sequence: Synthetic oligonucleotide

SEQ ID NO: 2736 - DNA, 50 bp, Artificial Sequence; identical to SEQ ID NO: 2731
  Description of Artificial Sequence: Synthetic oligonucleotide

SEQ ID NO: 2737 - DNA, 49 bp, Artificial Sequence
  Description of Artificial Sequence: Synthetic oligonucleotide
gccgagggtgttcttgacgattaatcaacagtccaatatcagatggaaa

SEQ ID NO: 2738 - DNA, 50 bp, Artificial Sequence; identical to SEQ ID NO: 2731
  Description of Artificial Sequence: Synthetic oligonucleotide

SEQ ID NO: 2739 - DNA, 50 bp, Artificial Sequence; identical to SEQ ID NO: 2731
  Description of Artificial Sequence: Synthetic oligonucleotide

SEQ ID NO: 2740 - DNA, 50 bp, Artificial Sequence; identical to SEQ ID NO: 2731
  Description of Artificial Sequence: Synthetic oligonucleotide

SEQ ID NO: 2741 - DNA, 50 bp, Artificial Sequence; identical to SEQ ID NO: 2731
  Description of Artificial Sequence: Synthetic oligonucleotide

SEQ ID NO: 2742 - DNA, 50 bp, Artificial Sequence; identical to SEQ ID NO: 2731
  Description of Artificial Sequence: Synthetic oligonucleotide

SEQ ID NO: 2743 - DNA, 50 bp, Artificial Sequence; identical to SEQ ID NO: 2731
  Description of Artificial Sequence: Synthetic oligonucleotide

SEQ ID NO: 2744 - DNA, 50 bp, Artificial Sequence; identical to SEQ ID NO: 2731
  Description of Artificial Sequence: Synthetic oligonucleotide

SEQ ID NO: 2745 - DNA, 50 bp, Artificial Sequence; identical to SEQ ID NO: 2731
  Description of Artificial Sequence: Synthetic oligonucleotide

SEQ ID NO: 2746 - DNA, 48 bp, Artificial Sequence
  Description of Artificial Sequence: Synthetic oligonucleotide
gccgagggtgttcttgacgattaatcaacagtccaatatcagatggaa

SEQ ID NO: 2747 - DNA, 50 bp, Artificial Sequence; identical to SEQ ID NO: 2731
  Description of Artificial Sequence: Synthetic oligonucleotide

SEQ ID NO: 2748 - DNA, 50 bp, Artificial Sequence; identical to SEQ ID NO: 2731
  Description of Artificial Sequence: Synthetic oligonucleotide

SEQ ID NO: 2749 - DNA, 50 bp, Artificial Sequence; identical to SEQ ID NO: 2731
  Description of Artificial Sequence: Synthetic oligonucleotide

SEQ ID NO: 2750 - DNA, 50 bp, Artificial Sequence
  Description of Artificial Sequence: Synthetic oligonucleotide
cgagggtgttcttgacgattaatcaacagtccaatatcagatggaaatga

SEQ ID NO: 2751 - DNA, 50 bp, Artificial Sequence; identical to SEQ ID NO: 2750
  Description of Artificial Sequence: Synthetic oligonucleotide

SEQ ID NO: 2752 - DNA, 50 bp, Artificial Sequence; identical to SEQ ID NO: 2750
  Description of Artificial Sequence: Synthetic oligonucleotide

SEQ ID NO: 2753 - DNA, 50 bp, Artificial Sequence; identical to SEQ ID NO: 2750
  Description of Artificial Sequence: Synthetic oligonucleotide

SEQ ID NO: 2754 - DNA, 50 bp, Artificial Sequence
  Description of Artificial Sequence: Synthetic oligonucleotide
taatcaacagtccaatatcagatggaaatgatgcggagccttcgccatgt

SEQ ID NO: 2755 - DNA, 50 bp, Artificial Sequence; identical to SEQ ID NO: 2754
  Description of Artificial Sequence: Synthetic oligonucleotide

SEQ ID NO: 2756 - DNA, 100 bp, Artificial Sequence
  Description of Artificial Sequence: Synthetic polynucleotide
cgccaccatctttcgggctgccgagggtgttcttgacgattaatcaacagatgtacagatcagctctcaaaatgtcttctgtgtcttctgagcgtcttct

SEQ ID NO: 2757 - DNA, 50 bp, Artificial Sequence
  Description of Artificial Sequence: Synthetic oligonucleotide
gctgccgagggtgttcttgacgattaatcaacagatgtacagatcagctc

SEQ ID NO: 2758 - DNA, 50 bp, Artificial Sequence; identical to SEQ ID NO: 2757
  Description of Artificial Sequence: Synthetic oligonucleotide

SEQ ID NO: 2759 - DNA, 50 bp, Artificial Sequence; identical to SEQ ID NO: 2757
  Description of Artificial Sequence: Synthetic oligonucleotide

SEQ ID NO: 2760 - DNA, 50 bp, Artificial Sequence; identical to SEQ ID NO: 2757
  Description of Artificial Sequence: Synthetic oligonucleotide

SEQ ID NO: 2761 - DNA, 50 bp, Artificial Sequence
  Description of Artificial Sequence: Synthetic oligonucleotide
gccgagggtgttcttgacgattaatcaacagatgtacagatcagctctca

SEQ ID NO: 2762 - DNA, 100 bp, Artificial Sequence
  Description of Artificial Sequence: Synthetic polynucleotide
ctgctttcctttccctcagcacacagaggatgatgctgactttgatgaagtccaatatcagatggaaatgatgcggagccttcgccatgtaaacattgat

SEQ ID NO: 2763 - DNA, 50 bp, Artificial Sequence
  Description of Artificial Sequence: Synthetic oligonucleotide
cacacagaggatgatgctgactttgatgaagtccaatatcagatagaaat

SEQ ID NO: 2764 - DNA, 50 bp, Artificial Sequence
  Description of Artificial Sequence: Synthetic oligonucleotide
cagaggatgatgctgactttgatgaagtccaatatcagatggaaatgatg

SEQ ID NO: 2765 - DNA, 50 bp, Artificial Sequence; identical to SEQ ID NO: 2764
  Description of Artificial Sequence: Synthetic oligonucleotide

SEQ ID NO: 2766 - DNA, 50 bp, Artificial Sequence; identical to SEQ ID NO: 2764
  Description of Artificial Sequence: Synthetic oligonucleotide

SEQ ID NO: 2767 - DNA, 50 bp, Artificial Sequence; identical to SEQ ID NO: 2764
  Description of Artificial Sequence: Synthetic oligonucleotide

SEQ ID NO: 2768 - DNA, 50 bp, Artificial Sequence
  Description of Artificial Sequence: Synthetic oligonucleotide
aggatgatgctgactttgatgaagtccaatatcagatggaaatgatgcgg

SEQ ID NO: 2769 - DNA, 100 bp, Artificial Sequence
  Description of Artificial Sequence: Synthetic polynucleotide
cgccaccatctttcgggctgccgagggtgttcttgacgattaatcaacaggtaaggaggggaggcccgagcgggccgcggggccgggggctgcggggggc

SEQ ID NO: 2770 - DNA, 100 bp, Artificial Sequence
  Description of Artificial Sequence: Synthetic polynucleotide
aacatcattaaaaagttttttcttttaatttcctcttccccatcatccagtccaatatcagatggaaatgatgcggagccttcgccatgtaaacattgat

SEQ ID NO: 2771 - DNA, 100 bp, Artificial Sequence
  Description of Artificial Sequence: Synthetic polynucleotide
tgttcgagtgtaatttagagagcagcgtggagagtatcatctcaccaaagaaaggggatgtttgggctgaaggtgaagaagaagagaaataaggcagaga

SEQ ID NO: 2772 - DNA, 50 bp, Artificial Sequence
  Description of Artificial Sequence: Synthetic oligonucleotide
gagcagcgtggagagtatcatctcaccaaagaaaggggatgtttgggctg

SEQ ID NO: 2773 - DNA, 50 bp, Artificial Sequence; identical to SEQ ID NO: 2772
  Description of Artificial Sequence: Synthetic oligonucleotide

SEQ ID NO: 2774 - DNA, 100 bp, Artificial Sequence
  Description of Artificial Sequence: Synthetic polynucleotide
tgttcgagtgtaatttagagagcagcgtggagagtatcatctcaccaaaggtgaaaatggcattacggacatcaggacatctcttactgggagtagttcg

SEQ ID NO: 2775 - DNA, 50 bp, Artificial Sequence
  Description of Artificial Sequence: Synthetic oligonucleotide
gagagcagtgtggagagtatcatctcaccaaaggtgaaaatggcattacg

SEQ ID NO: 2776 - DNA, 50 bp, Artificial Sequence; identical to SEQ ID NO: 2775
  Description of Artificial Sequence: Synthetic oligonucleotide

SEQ ID NO: 2777 - DNA, 50 bp, Artificial Sequence
  Description of Artificial Sequence: Synthetic oligonucleotide
agagcagcgtggagagtatcatctcaccaaaggtgaaaatggcattacgg

SEQ ID NO: 2778 - DNA, 50 bp, Artificial Sequence; identical to SEQ ID NO: 2777
  Description of Artificial Sequence: Synthetic oligonucleotide

SEQ ID NO: 2779 - DNA, 50 bp, Artificial Sequence; identical to SEQ ID NO: 2777
  Description of Artificial Sequence: Synthetic oligonucleotide

SEQ ID NO: 2780 - DNA, 50 bp, Artificial Sequence; identical to SEQ ID NO: 2777
  Description of Artificial Sequence: Synthetic oligonucleotide

SEQ ID NO: 2781 - DNA, 50 bp, Artificial Sequence; identical to SEQ ID NO: 2777
  Description of Artificial Sequence: Synthetic oligonucleotide

SEQ ID NO: 2782 - DNA, 50 bp, Artificial Sequence
  Description of Artificial Sequence: Synthetic oligonucleotide
gagcagcgtggagagtatcatctcaccaaaggtgaaaatggcattacgga

SEQ ID NO: 2783 - DNA, 50 bp, Artificial Sequence; identical to SEQ ID NO: 2782
  Description of Artificial Sequence: Synthetic oligonucleotide

SEQ ID NO: 2784 - DNA, 50 bp, Artificial Sequence; identical to SEQ ID NO: 2782
  Description of Artificial Sequence: Synthetic oligonucleotide

SEQ ID NO: 2785 - DNA, 50 bp, Artificial Sequence; identical to SEQ ID NO: 2782
  Description of Artificial Sequence: Synthetic oligonucleotide

SEQ ID NO: 2786 - DNA, 50 bp, Artificial Sequence; identical to SEQ ID NO: 2782
  Description of Artificial Sequence: Synthetic oligonucleotide

SEQ ID NO: 2787 - DNA, 50 bp, Artificial Sequence; identical to SEQ ID NO: 2782
  Description of Artificial Sequence: Synthetic oligonucleotide

SEQ ID NO: 2788 - DNA, 50 bp, Artificial Sequence
  Description of Artificial Sequence: Synthetic oligonucleotide
agcagcgtggagagtatcatctcaccaaaggtgaaaatggcattacggac

SEQ ID NO: 2789 - DNA, 50 bp, Artificial Sequence; identical to SEQ ID NO: 2788
  Description of Artificial Sequence: Synthetic oligonucleotide

SEQ ID NO: 2790 - DNA, 50 bp, Artificial Sequence; identical to SEQ ID NO: 2788
  Description of Artificial Sequence: Synthetic oligonucleotide

SEQ ID NO: 2791 - DNA, 50 bp, Artificial Sequence; identical to SEQ ID NO: 2788
  Description of Artificial Sequence: Synthetic oligonucleotide

SEQ ID NO: 2792 - DNA, 50 bp, Artificial Sequence; identical to SEQ ID NO: 2788
  Description of Artificial Sequence: Synthetic oligonucleotide

SEQ ID NO: 2793 - DNA, 50 bp, Artificial Sequence; identical to SEQ ID NO: 2788
  Description of Artificial Sequence: Synthetic oligonucleotide

SEQ ID NO: 2794 - DNA, 50 bp, Artificial Sequence; identical to SEQ ID NO: 2788
  Description of Artificial Sequence: Synthetic oligonucleotide

SEQ ID NO: 2795 - DNA, 50 bp, Artificial Sequence; identical to SEQ ID NO: 2788
  Description of Artificial Sequence: Synthetic oligonucleotide

SEQ ID NO: 2796 - DNA, 50 bp, Artificial Sequence; identical to SEQ ID NO: 2788
  Description of Artificial Sequence: Synthetic oligonucleotide

SEQ ID NO: 2797 - DNA, 50 bp, Artificial Sequence; identical to SEQ ID NO: 2788
  Description of Artificial Sequence: Synthetic oligonucleotide

SEQ ID NO: 2798 - DNA, 50 bp, Artificial Sequence; identical to SEQ ID NO: 2788
  Description of Artificial Sequence: Synthetic oligonucleotide

SEQ ID NO: 2799 - DNA, 50 bp, Artificial Sequence; identical to SEQ ID NO: 2788
  Description of Artificial Sequence: Synthetic oligonucleotide

SEQ ID NO: 2800 - DNA, 50 bp, Artificial Sequence; identical to SEQ ID NO: 2788
  Description of Artificial Sequence: Synthetic oligonucleotide

SEQ ID NO: 2801 - DNA, 50 bp, Artificial Sequence; identical to SEQ ID NO: 2788
  Description of Artificial Sequence: Synthetic oligonucleotide

SEQ ID NO: 2802 - DNA, 50 bp, Artificial Sequence; identical to SEQ ID NO: 2788
  Description of Artificial Sequence: Synthetic oligonucleotide

SEQ ID NO: 2803 - DNA, 50 bp, Artificial Sequence; identical to SEQ ID NO: 2788
  Description of Artificial Sequence: Synthetic oligonucleotide

SEQ ID NO: 2804 - DNA, 50 bp, Artificial Sequence; identical to SEQ ID NO: 2788
  Description of Artificial Sequence: Synthetic oligonucleotide

SEQ ID NO: 2805 - DNA, 50 bp, Artificial Sequence; identical to SEQ ID NO: 2788
  Description of Artificial Sequence: Synthetic oligonucleotide

SEQ ID NO: 2806 - DNA, 50 bp, Artificial Sequence; identical to SEQ ID NO: 2788
  Description of Artificial Sequence: Synthetic oligonucleotide

SEQ ID NO: 2807 - DNA, 50 bp, Artificial Sequence; identical to SEQ ID NO: 2788
  Description of Artificial Sequence: Synthetic oligonucleotide

SEQ ID NO: 2808 - DNA, 50 bp, Artificial Sequence; identical to SEQ ID NO: 2788
  Description of Artificial Sequence: Synthetic oligonucleotide

SEQ ID NO: 2809 - DNA, 50 bp, Artificial Sequence
  Description of Artificial Sequence: Synthetic oligonucleotide
gcagcgtggagagtatcatctcaccaaaggtgaaaatggcattacggaca

SEQ ID NO: 2810 - DNA, 50 bp, Artificial Sequence; identical to SEQ ID NO: 2809
  Description of Artificial Sequence: Synthetic oligonucleotide

SEQ ID NO: 2811 - DNA, 50 bp, Artificial Sequence; identical to SEQ ID NO: 2809
  Description of Artificial Sequence: Synthetic oligonucleotide

SEQ ID NO: 2812 - DNA, 50 bp, Artificial Sequence
  Description of Artificial Sequence: Synthetic oligonucleotide
gcagcgtggagagtatcatttcaccaaaggtgaaaatggcattacggaca

SEQ ID NO: 2813 - DNA, 50 bp, Artificial Sequence; identical to SEQ ID NO: 2809
  Description of Artificial Sequence: Synthetic oligonucleotide

SEQ ID NO: 2814 - DNA, 50 bp, Artificial Sequence; identical to SEQ ID NO: 2809
  Description of Artificial Sequence: Synthetic oligonucleotide

SEQ ID NO: 2815 - DNA, 50 bp, Artificial Sequence; identical to SEQ ID NO: 2809
  Description of Artificial Sequence: Synthetic oligonucleotide

SEQ ID NO: 2816 - DNA, 50 bp, Artificial Sequence; identical to SEQ ID NO: 2809
  Description of Artificial Sequence: Synthetic oligonucleotide

SEQ ID NO: 2817 - DNA, 50 bp, Artificial Sequence; identical to SEQ ID NO: 2809
  Description of Artificial Sequence: Synthetic oligonucleotide

SEQ ID NO: 2818 - DNA, 50 bp, Artificial Sequence; identical to SEQ ID NO: 2809
  Description of Artificial Sequence: Synthetic oligonucleotide

SEQ ID NO: 2819 - DNA, 50 bp, Artificial Sequence
  Description of Artificial Sequence: Synthetic oligonucleotide
agcgtggagagtatcatctcaccaaaggtgaaaatggcattacggacatc

SEQ ID NO: 2820 - DNA, 50 bp, Artificial Sequence; identical to SEQ ID NO: 2819
  Description of Artificial Sequence: Synthetic oligonucleotide

SEQ ID NO: 2821 - DNA, 47 bp, Artificial Sequence
  Description of Artificial Sequence: Synthetic oligonucleotide
agcgtggagagtatcatctcaccaaaggtgaaaatggcattacggac

SEQ ID NO: 2822 - DNA, 50 bp, Artificial Sequence; identical to SEQ ID NO: 2819
  Description of Artificial Sequence: Synthetic oligonucleotide

SEQ ID NO: 2823 - DNA, 50 bp, Artificial Sequence
  Description of Artificial Sequence: Synthetic oligonucleotide
cgtggagagtatcatctcaccaaaggtgaaaatggcattacggacatcag

SEQ ID NO: 2824 - DNA, 50 bp, Artificial Sequence; identical to SEQ ID NO: 2823
  Description of Artificial Sequence: Synthetic oligonucleotide

SEQ ID NO: 2825 - DNA, 50 bp, Artificial Sequence; identical to SEQ ID NO: 2823
  Description of Artificial Sequence: Synthetic oligonucleotide

SEQ ID NO: 2826 - DNA, 50 bp, Artificial Sequence; identical to SEQ ID NO: 2823
  Description of Artificial Sequence: Synthetic oligonucleotide

SEQ ID NO: 2827 - DNA, 50 bp, Artificial Sequence; identical to SEQ ID NO: 2823
  Description of Artificial Sequence: Synthetic oligonucleotide

SEQ ID NO: 2828 - DNA, 50 bp, Artificial Sequence; identical to SEQ ID NO: 2823
  Description of Artificial Sequence: Synthetic oligonucleotide

SEQ ID NO: 2829 - DNA, 50 bp, Artificial Sequence; identical to SEQ ID NO: 2823
  Description of Artificial Sequence: Synthetic oligonucleotide

SEQ ID NO: 2830 - DNA, 50 bp, Artificial Sequence; identical to SEQ ID NO: 2823
  Description of Artificial Sequence: Synthetic oligonucleotide

SEQ ID NO: 2831 - DNA, 50 bp, Artificial Sequence; identical to SEQ ID NO: 2823
  Description of Artificial Sequence: Synthetic oligonucleotide

SEQ ID NO: 2832 - DNA, 50 bp, Artificial Sequence; identical to SEQ ID NO: 2823
  Description of Artificial Sequence: Synthetic oligonucleotide

SEQ ID NO: 2833 - DNA, 50 bp, Artificial Sequence; identical to SEQ ID NO: 2823
  Description of Artificial Sequence: Synthetic oligonucleotide

SEQ ID NO: 2834 - DNA, 50 bp, Artificial Sequence; identical to SEQ ID NO: 2823
  Description of Artificial Sequence: Synthetic oligonucleotide

SEQ ID NO: 2835 - DNA, 50 bp, Artificial Sequence; identical to SEQ ID NO: 2823
  Description of Artificial Sequence: Synthetic oligonucleotide

SEQ ID NO: 2836 - DNA, 50 bp, Artificial Sequence; identical to SEQ ID NO: 2823
  Description of Artificial Sequence: Synthetic oligonucleotide

SEQ ID NO: 2837 - DNA, 50 bp, Artificial Sequence; identical to SEQ ID NO: 2823
  Description of Artificial Sequence: Synthetic oligonucleotide

SEQ ID NO: 2838 - DNA, 50 bp, Artificial Sequence; identical to SEQ ID NO: 2823
  Description of Artificial Sequence: Synthetic oligonucleotide

SEQ ID NO: 2839 - DNA, 50 bp, Artificial Sequence; identical to SEQ ID NO: 2823
  Description of Artificial Sequence: Synthetic oligonucleotide

SEQ ID NO: 2840 - DNA, 50 bp, Artificial Sequence
  Description of Artificial Sequence: Synthetic oligonucleotide
gtggagagtatcatctcaccaaaggtgaaaatggcattacggacatcagg

SEQ ID NO: 2841 - DNA, 50 bp, Artificial Sequence; identical to SEQ ID NO: 2840
  Description of Artificial Sequence: Synthetic oligonucleotide

SEQ ID NO: 2842 - DNA, 50 bp, Artificial Sequence; identical to SEQ ID NO: 2840
  Description of Artificial Sequence: Synthetic oligonucleotide

SEQ ID NO: 2843 - DNA, 50 bp, Artificial Sequence; identical to SEQ ID NO: 2840
  Description of Artificial Sequence: Synthetic oligonucleotide

SEQ ID NO: 2844 - DNA, 50 bp, Artificial Sequence; identical to SEQ ID NO: 2840
  Description of Artificial Sequence: Synthetic oligonucleotide

SEQ ID NO: 2845 - DNA, 50 bp, Artificial Sequence
  Description of Artificial Sequence: Synthetic oligonucleotide
gtggagagtatcatctcaccaaaggtgaaaatggcattacggacgtcagg

SEQ ID NO: 2846 - DNA, 50 bp, Artificial Sequence; identical to SEQ ID NO: 2840
  Description of Artificial Sequence: Synthetic oligonucleotide

SEQ ID NO: 2847 - DNA, 50 bp, Artificial Sequence; identical to SEQ ID NO: 2840
  Description of Artificial Sequence: Synthetic oligonucleotide

SEQ ID NO: 2848 - DNA, 50 bp, Artificial Sequence; identical to SEQ ID NO: 2840
  Description of Artificial Sequence: Synthetic oligonucleotide

SEQ ID NO: 2849 - DNA, 50 bp, Artificial Sequence; identical to SEQ ID NO: 2840
  Description of Artificial Sequence: Synthetic oligonucleotide

SEQ ID NO: 2850 - DNA, 50 bp, Artificial Sequence; identical to SEQ ID NO: 2845
  Description of Artificial Sequence: Synthetic oligonucleotide

SEQ ID NO: 2851 - DNA, 50 bp, Artificial Sequence; identical to SEQ ID NO: 2840
  Description of Artificial Sequence: Synthetic oligonucleotide

SEQ ID NO: 2852 - DNA, 50 bp, Artificial Sequence; identical to SEQ ID NO: 2840
  Description of Artificial Sequence: Synthetic oligonucleotide

SEQ ID NO: 2853 - DNA, 50 bp, Artificial Sequence; identical to SEQ ID NO: 2840
  Description of Artificial Sequence: Synthetic oligonucleotide

SEQ ID NO: 2854 - DNA, 50 bp, Artificial Sequence; identical to SEQ ID NO: 2845
  Description of Artificial Sequence: Synthetic oligonucleotide

SEQ ID NO: 2855 - DNA, 50 bp, Artificial Sequence; identical to SEQ ID NO: 2840
  Description of Artificial Sequence: Synthetic oligonucleotide

SEQ ID NO: 2856 - DNA, 50 bp, Artificial Sequence; identical to SEQ ID NO: 2840
  Description of Artificial Sequence: Synthetic oligonucleotide

SEQ ID NO: 2857 - DNA, 50 bp, Artificial Sequence; identical to SEQ ID NO: 2840
  Description of Artificial Sequence: Synthetic oligonucleotide

SEQ ID NO: 2858 - DNA, 50 bp, Artificial Sequence; identical to SEQ ID NO: 2845
  Description of Artificial Sequence: Synthetic oligonucleotide

SEQ ID NO: 2859 - DNA, 50 bp, Artificial Sequence; identical to SEQ ID NO: 2840
  Description of Artificial Sequence: Synthetic oligonucleotide

SEQ ID NO: 2860 - DNA, 50 bp, Artificial Sequence; identical to SEQ ID NO: 2845
  Description of Artificial Sequence: Synthetic oligonucleotide

SEQ ID NO: 2861 - DNA, 50 bp, Artificial Sequence; identical to SEQ ID NO: 2840
  Description of Artificial Sequence: Synthetic oligonucleotide

SEQ ID NO: 2862 - DNA, 50 bp, Artificial Sequence; identical to SEQ ID NO: 2840
  Description of Artificial Sequence: Synthetic oligonucleotide

SEQ ID NO: 2863 - DNA, 50 bp, Artificial Sequence; identical to SEQ ID NO: 2840
  Description of Artificial Sequence: Synthetic oligonucleotide

SEQ ID NO: 2864 - DNA, 50 bp, Artificial Sequence; identical to SEQ ID NO: 2840
  Description of Artificial Sequence: Synthetic oligonucleotide

SEQ ID NO: 2865 - DNA, 50 bp, Artificial Sequence
  Description of Artificial Sequence: Synthetic oligonucleotide
ggagagtatcatctcaccaaaggtgaaaatggcattacggacatcaggac

SEQ ID NO: 2866 - DNA, 50 bp, Artificial Sequence
  Description of Artificial Sequence: Synthetic oligonucleotide
ggagagtatcatctcaccaaaggtgaaaatggcattatggacatcaggac

SEQ ID NO: 2867 - DNA, 50 bp, Artificial Sequence; identical to SEQ ID NO: 2866
  Description of Artificial Sequence: Synthetic oligonucleotide

SEQ ID NO: 2868 - DNA, 50 bp, Artificial Sequence; identical to SEQ ID NO: 2865
  Description of Artificial Sequence: Synthetic oligonucleotide

SEQ ID NO: 2869 - DNA, 50 bp, Artificial Sequence; identical to SEQ ID NO: 2866
  Description of Artificial Sequence: Synthetic oligonucleotide

SEQ ID NO: 2870 - DNA, 50 bp, Artificial Sequence; identical to SEQ ID NO: 2866
  Description of Artificial Sequence: Synthetic oligonucleotide

SEQ ID NO: 2871 - DNA, 50 bp, Artificial Sequence; identical to SEQ ID NO: 2865
  Description of Artificial Sequence: Synthetic oligonucleotide

SEQ ID NO: 2872 - DNA, 50 bp, Artificial Sequence; identical to SEQ ID NO: 2866
  Description of Artificial Sequence: Synthetic oligonucleotide

SEQ ID NO: 2873 - DNA, 50 bp, Artificial Sequence; identical to SEQ ID NO: 2865
  Description of Artificial Sequence: Synthetic oligonucleotide

SEQ ID NO: 2874 - DNA, 50 bp, Artificial Sequence; identical to SEQ ID NO: 2865
  Description of Artificial Sequence: Synthetic oligonucleotide

SEQ ID NO: 2875 - DNA, 50 bp, Artificial Sequence; identical to SEQ ID NO: 2866
  Description of Artificial Sequence: Synthetic oligonucleotide

SEQ ID NO: 2876 - DNA, 100 bp, Artificial Sequence
  Description of Artificial Sequence: Synthetic polynucleotide
tgatcagagcaatgctgtgtggaccatcgtgaaggtggacaaggcattttaaaggggatgtttgggctgaaggtgaagaagaagagaaataaggcagaga

SEQ ID NO: 2877 - DNA, 100 bp, Artificial Sequence
  Description of Artificial Sequence: Synthetic polynucleotide
tgttcgagtgtaatttagagagcagcgtggagagtatcatctcaccaaaggtatgtttgatgttgacatttttattcactttgttgattgtttattgata

SEQ ID NO: 2878 - DNA, 50 bp, Artificial Sequence
  Description of Artificial Sequence: Synthetic oligonucleotide
agagagcagcgtggagagtatcatctcaccaaaggtatgtttgatgttga

SEQ ID NO: 2879 - DNA, 50 bp, Artificial Sequence; identical to SEQ ID NO: 2878
  Description of Artificial Sequence: Synthetic oligonucleotide

SEQ ID NO: 2880 - DNA, 50 bp, Artificial Sequence; identical to SEQ ID NO: 2878
  Description of Artificial Sequence: Synthetic oligonucleotide

SEQ ID NO: 2881 - DNA, 50 bp, Artificial Sequence; identical to SEQ ID NO: 2878
  Description of Artificial Sequence: Synthetic oligonucleotide

SEQ ID NO: 2882 - DNA, 50 bp, Artificial Sequence; identical to SEQ ID NO: 2878
  Description of Artificial Sequence: Synthetic oligonucleotide

SEQ ID NO: 2883 - DNA, 50 bp, Artificial Sequence; identical to SEQ ID NO: 2878
  Description of Artificial Sequence: Synthetic oligonucleotide

SEQ ID NO: 2884 - DNA, 50 bp, Artificial Sequence; identical to SEQ ID NO: 2878
  Description of Artificial Sequence: Synthetic oligonucleotide

SEQ ID NO: 2885 - DNA, 50 bp, Artificial Sequence
  Description of Artificial Sequence: Synthetic oligonucleotide
gagcagcgtggagagtatcatctcaccaaaggtatgtttgatgttgacat

SEQ ID NO: 2886 - DNA, 50 bp, Artificial Sequence; identical to SEQ ID NO: 2885
  Description of Artificial Sequence: Synthetic oligonucleotide

SEQ ID NO: 2887 - DNA, 50 bp, Artificial Sequence; identical to SEQ ID NO: 2885
  Description of Artificial Sequence: Synthetic oligonucleotide

SEQ ID NO: 2888 - DNA, 50 bp, Artificial Sequence; identical to SEQ ID NO: 2885
  Description of Artificial Sequence: Synthetic oligonucleotide

SEQ ID NO: 2889 - DNA, 50 bp, Artificial Sequence; identical to SEQ ID NO: 2885
  Description of Artificial Sequence: Synthetic oligonucleotide

SEQ ID NO: 2890 - DNA, 50 bp, Artificial Sequence; identical to SEQ ID NO: 2885
  Description of Artificial Sequence: Synthetic oligonucleotide

SEQ ID NO: 2891 - DNA, 50 bp, Artificial Sequence
  Description of Artificial Sequence: Synthetic oligonucleotide
agcagcgtggagagtatcatcttaccaaaggtatgtttgatgttgacatt

SEQ ID NO: 2892 - DNA, 50 bp, Artificial Sequence; identical to SEQ ID NO: 2891
  Description of Artificial Sequence: Synthetic oligonucleotide

SEQ ID NO: 2893 - DNA, 50 bp, Artificial Sequence; identical to SEQ ID NO: 2891
  Description of Artificial Sequence: Synthetic oligonucleotide

SEQ ID NO: 2894 - DNA, 50 bp, Artificial Sequence; identical to SEQ ID NO: 2891
  Description of Artificial Sequence: Synthetic oligonucleotide

SEQ ID NO: 2895 - DNA, 50 bp, Artificial Sequence; identical to SEQ ID NO: 2891
  Description of Artificial Sequence: Synthetic oligonucleotide

SEQ ID NO: 2896 - DNA, 50 bp, Artificial Sequence; identical to SEQ ID NO: 2891
  Description of Artificial Sequence: Synthetic oligonucleotide

SEQ ID NO: 2897 - DNA, 49 bp, Artificial Sequence
  Description of Artificial Sequence: Synthetic oligonucleotide
cagcgtggagagtatcatctcaccaaaggtatgtttgatgttgacattt

SEQ ID NO: 2898 - DNA, 49 bp, Artificial Sequence; identical to SEQ ID NO: 2897
  Description of Artificial Sequence: Synthetic oligonucleotide

SEQ ID NO: 2899 - DNA, 49 bp, Artificial Sequence; identical to SEQ ID NO: 2897
  Description of Artificial Sequence: Synthetic oligonucleotide

SEQ ID NO: 2900 - DNA, 49 bp, Artificial Sequence; identical to SEQ ID NO: 2897
  Description of Artificial Sequence: Synthetic oligonucleotide

SEQ ID NO: 2901 - DNA, 49 bp, Artificial Sequence; identical to SEQ ID NO: 2897
  Description of Artificial Sequence: Synthetic oligonucleotide

SEQ ID NO: 2902 - DNA, 49 bp, Artificial Sequence; identical to SEQ ID NO: 2897
  Description of Artificial Sequence: Synthetic oligonucleotide

SEQ ID NO: 2903 - DNA, 50 bp, Artificial Sequence
  Description of Artificial Sequence: Synthetic oligonucleotide
gcgtggagagtatcatcttaccaaaggtatgtttgatgttgacattttta

SEQ ID NO: 2904 - DNA, 50 bp, Artificial Sequence; identical to SEQ ID NO: 2903
  Description of Artificial Sequence: Synthetic oligonucleotide

SEQ ID NO: 2905 - DNA, 50 bp, Artificial Sequence; identical to SEQ ID NO: 2903
  Description of Artificial Sequence: Synthetic oligonucleotide

SEQ ID NO: 2906 - DNA, 50 bp, Artificial Sequence; identical to SEQ ID NO: 2903
  Description of Artificial Sequence: Synthetic oligonucleotide

SEQ ID NO: 2907 - DNA, 50 bp, Artificial Sequence; identical to SEQ ID NO: 2903
  Description of Artificial Sequence: Synthetic oligonucleotide

SEQ ID NO: 2908 - DNA, 50 bp, Artificial Sequence; identical to SEQ ID NO: 2903
  Description of Artificial Sequence: Synthetic oligonucleotide

SEQ ID NO: 2909 - DNA, 50 bp, Artificial Sequence; identical to SEQ ID NO: 2903
  Description of Artificial Sequence: Synthetic oligonucleotide

SEQ ID NO: 2910 - DNA, 50 bp, Artificial Sequence; identical to SEQ ID NO: 2903
  Description of Artificial Sequence: Synthetic oligonucleotide

SEQ ID NO: 2911 - DNA, 50 bp, Artificial Sequence; identical to SEQ ID NO: 2903
  Description of Artificial Sequence: Synthetic oligonucleotide

SEQ ID NO: 2912 - DNA, 50 bp, Artificial Sequence; identical to SEQ ID NO: 2903
  Description of Artificial Sequence: Synthetic oligonucleotide

SEQ ID NO: 2913 - DNA, 50 bp, Artificial Sequence; identical to SEQ ID NO: 2903
  Description of Artificial Sequence: Synthetic oligonucleotide

SEQ ID NO: 2914 - DNA, 100 bp, Artificial Sequence
  Description of Artificial Sequence: Synthetic polynucleotide
gtctaaatgactcaaagtttttattgtttctttttttttcttcttttcagaaaggggatgtttgggctgaaggtgaagaagaagagaaataaggcagaga

SEQ ID NO: 2915 - DNA, 100 bp, Artificial Sequence
  Description of Artificial Sequence: Synthetic polynucleotide
ccaggcctgccggctccgtaaatgctacgaagtgggaatgatgaaaggtgttggacagagagactctgaagatgtgagcaaaagagactccgataaagag

SEQ ID NO: 2916 - DNA, 47 bp, Artificial Sequence
  Description of Artificial Sequence: Synthetic oligonucleotide
tgggaatgatgaaaggtgttggacagagagactctgaagatgtgagc

SEQ ID NO: 2917 - DNA, 47 bp, Artificial Sequence; identical to SEQ ID NO: 2916
  Description of Artificial Sequence: Synthetic oligonucleotide

SEQ ID NO: 2918 - DNA, 47 bp, Artificial Sequence; identical to SEQ ID NO: 2916
  Description of Artificial Sequence: Synthetic oligonucleotide

SEQ ID NO: 2919 - DNA, 47 bp, Artificial Sequence; identical to SEQ ID NO: 2916
  Description of Artificial Sequence: Synthetic oligonucleotide

SEQ ID NO: 2920 - DNA, 47 bp, Artificial Sequence; identical to SEQ ID NO: 2916
  Description of Artificial Sequence: Synthetic oligonucleotide

SEQ ID NO: 2921 - DNA, 100 bp, Artificial Sequence
  Description of Artificial Sequence: Synthetic polynucleotide
ccaggcctgccggctccgtaaatgctacgaagtgggaatgatgaaaggtgggatacgaaaagaccgaagaggagggagaatgttgaaacacaagcgccag

SEQ ID NO: 2922 - DNA, 100 bp, Artificial Sequence; identical to SEQ ID NO: 600
  Description of Artificial Sequence: Synthetic polynucleotide

SEQ ID NO: 2923 - DNA, 100 bp, Artificial Sequence
  Description of Artificial Sequence: Synthetic polynucleotide
ccaggcctgccggctccgtaaatgctacgaagtgggaatgatgaaaggtggtaggtacatctctcccaggggcccttggggatggccctggccaccgccc

SEQ ID NO: 2924 - DNA, 100 bp, Artificial Sequence; identical to SEQ ID NO: 728
  Description of Artificial Sequence: Synthetic polynucleotide

SEQ ID NO: 2925 - DNA, 100 bp, Artificial Sequence
  Description of Artificial Sequence: Synthetic polynucleotide
gtaaaacattgcggcaacaccatggctgggtagttcgaggggtttttgcgggacaggagagagtggcaagagtacgtttatcaagcagatgagaatcatc

SEQ ID NO: 2926 - DNA, 50 bp, Artificial Sequence
  Description of Artificial Sequence: Synthetic oligonucleotide
gctgggtagttcgaggggtttttgcgggacaggagagagtggcaagagta

SEQ ID NO: 2927 - DNA, 100 bp, Artificial Sequence
  Description of Artificial Sequence: Synthetic polynucleotide
gtaaaacattgcggcaacaccatggctgggtagttcgaggggtttttgcgttagctttaagggcagctccatcctatgaagattttgtggccgcgttaac

SEQ ID NO: 2928 - DNA, 100 bp, Artificial Sequence
  Description of Artificial Sequence: Synthetic polynucleotide
ccgcagggacaagcgggacgcccgccgggagctcaagctgctgctgctcgggacaggagagagtggcaagagtacgtttatcaagcagatgagaatcatc

SEQ ID NO: 2929 - DNA, 49 bp, Artificial Sequence
  Description of Artificial Sequence: Synthetic oligonucleotide
gggagctcaagctgctgctgctcgggacaggagagagtggcaagagtac

SEQ ID NO: 2930 - DNA, 50 bp, Artificial Sequence
  Description of Artificial Sequence: Synthetic oligonucleotide
gctgctgctcgggacaggagagagtggcaagagtacgtttatcaagcaga

SEQ ID NO: 2931 - DNA, 100 bp, Artificial Sequence
  Description of Artificial Sequence: Synthetic polynucleotide
gtaaaacattgcggcaacaccatggctgggtagttcgaggggtttttgcggtaagtgatccttcttgtctcctattattaactgtattgggtatgccagt

SEQ ID NO: 2932 - DNA, 100 bp, Artificial Sequence
  Description of Artificial Sequence: Synthetic polynucleotide
agactgagatggcactgtggtctgatgagctgctattgttcatctttcagggacaggagagagtggcaagagtacgtttatcaagcagatgagaatcatc

SEQ ID NO: 2933 - DNA, 100 bp, Artificial Sequence
  Description of Artificial Sequence: Synthetic polynucleotide
ggcgccgagggacgccgaggcctcgggcgggggctggcccggggttccaggttgacaggactgaggtgattcgcacctgcataaacccagtgtactcaaa

SEQ ID NO: 2934 - DNA, 50 bp, Artificial Sequence
  Description of Artificial Sequence: Synthetic oligonucleotide
gggggctggcccggggttccaggttgacaggactgaggtgattcgcacct

SEQ ID NO: 2935 - DNA, 100 bp, Artificial Sequence
  Description of Artificial Sequence: Synthetic polynucleotide
ggcgccgagggacgccgaggcctcgggcgggggctggcccggggttccaggtctccagtgggggctgcagactaagcaaaatgaggcggttcctgaggcc

SEQ ID NO: 2936 - DNA, 50 bp, Artificial Sequence
  Description of Artificial Sequence: Synthetic oligonucleotide
ggcccggggttccaggtctccagtgggggctgcagactaagcaaaatgag

SEQ ID NO: 2937 - DNA, 50 bp, Artificial Sequence; identical to SEQ ID NO: 2936
  Description of Artificial Sequence: Synthetic oligonucleotide

SEQ ID NO: 2938 - DNA, 100 bp, Artificial Sequence
  Description of Artificial Sequence: Synthetic polynucleotide
cagacccctgtgtcatcctcaagatgcagtctcatgggcagtggtttgaggttgacaggactgaggtgattcgcacctgcataaacccagtgtactcaaa

SEQ ID NO: 2939 - DNA, 100 bp, Artificial Sequence
  Description of Artificial Sequence: Synthetic polynucleotide
ggcgccgagggacgccgaggcctcgggcgggggctggcccggggttccaggtgagatgcgtgccggactcgcccagccgggcccgccccctcggggcttc

SEQ ID NO: 2940 - DNA, 100 bp, Artificial Sequence
  Description of Artificial Sequence: Synthetic polynucleotide
ataataaaaataatccttatctctgataggttttctctttctccttgcaggttgacaggactgaggtgattcgcacctgcataaacccagtgtactcaaa

SEQ ID NO: 2941 - DNA, 100 bp, Artificial Sequence
  Description of Artificial Sequence: Synthetic polynucleotide
acctagccccggacgagaagcgcagcaacgtgcggtgggaccacgagagctgtcctctacaagcctggtgatgcccacacaccacttacttcgtgcgcaa

SEQ ID NO: 2942 - DNA, 50 bp, Artificial Sequence
  Description of Artificial Sequence: Synthetic oligonucleotide
cggtgggaccacgagagctgtcctctataagcctggtgatgcccacacac

SEQ ID NO: 2943 - DNA, 50 bp, Artificial Sequence; identical to SEQ ID NO: 2942
  Description of Artificial Sequence: Synthetic oligonucleotide

SEQ ID NO: 2944 - DNA, 50 bp, Artificial Sequence; identical to SEQ ID NO: 2942
  Description of Artificial Sequence: Synthetic oligonucleotide

SEQ ID NO: 2945 - DNA, 50 bp, Artificial Sequence
  Description of Artificial Sequence: Synthetic oligonucleotide
cgagagctgtcctctacaagcctggtgatgtccacacaccacttacttcg

SEQ ID NO: 2946 - DNA, 100 bp, Artificial Sequence
  Description of Artificial Sequence: Synthetic polynucleotide
acctagccccggacgagaagcgcagcaacgtgcggtgggaccacgagagcgtttgtaaatattatctctgtggtttttgtcctgcggaattgttcacaaa

SEQ ID NO: 2947 - DNA, 50 bp, Artificial Sequence
  Description of Artificial Sequence: Synthetic oligonucleotide
tgcggtgggaccacgagagcgtttgtaaatattatctctgtggtttttgt

SEQ ID NO: 2948 - DNA, 50 bp, Artificial Sequence; identical to SEQ ID NO: 2947
  Description of Artificial Sequence: Synthetic oligonucleotide

SEQ ID NO: 2949 - DNA, 50 bp, Artificial Sequence
  Description of Artificial Sequence: Synthetic oligonucleotide
gcggtgggaccacgagagcgtttgtaaatattatctctgtggtttttgtc

SEQ ID NO: 2950 - DNA, 50 bp, Artificial Sequence; identical to SEQ ID NO: 2949
  Description of Artificial Sequence: Synthetic oligonucleotide

SEQ ID NO: 2951 - DNA, 50 bp, Artificial Sequence; identical to SEQ ID NO: 2949
  Description of Artificial Sequence: Synthetic oligonucleotide

SEQ ID NO: 2952 - DNA, 50 bp, Artificial Sequence
  Description of Artificial Sequence: Synthetic oligonucleotide
gcggtgggaccacgagagcgtttgtaaacattatctctgtggtttttgtc

SEQ ID NO: 2953 - DNA, 50 bp, Artificial Sequence
  Description of Artificial Sequence: Synthetic oligonucleotide
ggtgggaccatgagagcgtttgtaaatattatctctgtggtttttgtcct

SEQ ID NO: 2954 - DNA, 50 bp, Artificial Sequence; identical to SEQ ID NO: 2953
  Description of Artificial Sequence: Synthetic oligonucleotide

SEQ ID NO: 2955 - DNA, 50 bp, Artificial Sequence
  Description of Artificial Sequence: Synthetic oligonucleotide
gggaccacgagagcgtttgtaaatattatctctgtggtttttgtcctgcg

SEQ ID NO: 2956 - DNA, 50 bp, Artificial Sequence; identical to SEQ ID NO: 2955
  Description of Artificial Sequence: Synthetic oligonucleotide

SEQ ID NO: 2957 - DNA, 50 bp, Artificial Sequence
  Description of Artificial Sequence: Synthetic oligonucleotide
cacgagagcgtttgtaaatattatctctgtggtttttgtcctgcggaatt

SEQ ID NO: 2958 - DNA, 50 bp, Artificial Sequence; identical to SEQ ID NO: 2957
  Description of Artificial Sequence: Synthetic oligonucleotide

SEQ ID NO: 2959 - DNA, 50 bp, Artificial Sequence; identical to SEQ ID NO: 2957
  Description of Artificial Sequence: Synthetic oligonucleotide

SEQ ID NO: 2960 - DNA, 50 bp, Artificial Sequence; identical to SEQ ID NO: 2957
  Description of Artificial Sequence: Synthetic oligonucleotide

SEQ ID NO: 2961 - DNA, 50 bp, Artificial Sequence; identical to SEQ ID NO: 2957
  Description of Artificial Sequence: Synthetic oligonucleotide

SEQ ID NO: 2962 - DNA, 50 bp, Artificial Sequence; identical to SEQ ID NO: 2957
  Description of Artificial Sequence: Synthetic oligonucleotide

SEQ ID NO: 2963 - DNA, 100 bp, Artificial Sequence
  Description of Artificial Sequence: Synthetic polynucleotide
cagataccagcagcatcagtacactcaccaacatgtcttcaagtaaacagtgtcctctacaagcctggtgatgcccacacaccacttacttcgtgcgcaa

SEQ ID NO: 2964 - DNA, 100 bp, Artificial Sequence
  Description of Artificial Sequence: Synthetic polynucleotide
acctagccccggacgagaagcgcagcaacgtgcggtgggaccacgagagcgtaagtcccgcgggccttggcctgagcccgggctccgtgggggaggggag

SEQ ID NO: 2965 - DNA, 100 bp, Artificial Sequence
  Description of Artificial Sequence: Synthetic polynucleotide
gaccctgccaaatgacacagctgagcactctctctcctctctctctgcagtgtcctctacaagcctggtgatgcccacacaccacttacttcgtgcgcaa

SEQ ID NO: 2966 - DNA, 100 bp, Artificial Sequence; identical to SEQ ID NO: 2000
  Description of Artificial Sequence: Synthetic polynucleotide

SEQ ID NO: 2967 - DNA, 50 bp, Artificial Sequence
  Description of Artificial Sequence: Synthetic oligonucleotide
gaaactgacattatttggaaaatctacttccttatcaagcacccctacag

SEQ ID NO: 2968 - DNA, 50 bp, Artificial Sequence; identical to SEQ ID NO: 2967
  Description of Artificial Sequence: Synthetic oligonucleotide

SEQ ID NO: 2969 - DNA, 50 bp, Artificial Sequence; identical to SEQ ID NO: 2967
  Description of Artificial Sequence: Synthetic oligonucleotide

SEQ ID NO: 2970 - DNA, 100 bp, Artificial Sequence; identical to SEQ ID NO: 2004
  Description of Artificial Sequence: Synthetic polynucleotide

SEQ ID NO: 2971 - DNA, 100 bp, Artificial Sequence; identical to SEQ ID NO: 2005
  Description of Artificial Sequence: Synthetic polynucleotide

SEQ ID NO: 2972 - DNA, 100 bp, Artificial Sequence; identical to SEQ ID NO: 2006
  Description of Artificial Sequence: Synthetic polynucleotide

SEQ ID NO: 2973 - DNA, 100 bp, Artificial Sequence; identical to SEQ ID NO: 2007
  Description of Artificial Sequence: Synthetic polynucleotide

SEQ ID NO: 2974 - DNA, 100 bp, Artificial Sequence
  Description of Artificial Sequence: Synthetic polynucleotide
gcaggagctggctgcggagcggcgagggacctcgcagggagccatccgatgaggcagacagtggggaggaagaatgccggtcacagcccaggagcatcag

SEQ ID NO: 2975 - DNA, 50 bp, Artificial Sequence
  Description of Artificial Sequence: Synthetic oligonucleotide
cgcagggagccatccgatgaggcagacagtggggaggaagaatgccggtc

SEQ ID NO: 2976 - DNA, 50 bp, Artificial Sequence
  Description of Artificial Sequence: Synthetic oligonucleotide
cgcagggagccatccgatgaggcagacagtggggtggaagaatgccggtc

SEQ ID NO: 2977 - DNA, 50 bp, Artificial Sequence; identical to SEQ ID NO: 2975
  Description of Artificial Sequence: Synthetic oligonucleotide

SEQ ID NO: 2978 - DNA, 47 bp, Artificial Sequence
  Description of Artificial Sequence: Synthetic oligonucleotide
agggagccatccgatgaggcagacagtggggaggaagaatgccggtc

SEQ ID NO: 2979 - DNA, 100 bp, Artificial Sequence
  Description of Artificial Sequence: Synthetic polynucleotide
gcaggagctggctgcggagcggcgagggacctcgcagggagccatccgatgcgaaaacagaagaacagattgcagcagaagaggcctggaatgagacgga

SEQ ID NO: 2980 - DNA, 50 bp, Artificial Sequence
  Description of Artificial Sequence: Synthetic oligonucleotide
ggacctcgcagggagccatccgatgcgaaaacagaagaacagattgcagc

SEQ ID NO: 2981 - DNA, 50 bp, Artificial Sequence
  Description of Artificial Sequence: Synthetic oligonucleotide
gcagggagccatccgatgcgaaaacagaagaacagattgcagcagaagag

SEQ ID NO: 2982 - DNA, 50 bp, Artificial Sequence
  Description of Artificial Sequence: Synthetic oligonucleotide
gcagggagccatccgatgcgaaaacagaagaacaggttgcagcagaagag

SEQ ID NO: 2983 - DNA, 50 bp, Artificial Sequence; identical to SEQ ID NO: 2981
  Description of Artificial Sequence: Synthetic oligonucleotide

SEQ ID NO: 2984 - DNA, 100 bp, Artificial Sequence
  Description of Artificial Sequence: Synthetic polynucleotide
cggtccagcggtcacctacccccagcaccacctccagcccctgcgcctcggaggcagacagtggggaggaagaatgccggtcacagcccaggagcatcag

SEQ ID NO: 2985 - DNA, 50 bp, Artificial Sequence
  Description of Artificial Sequence: Synthetic oligonucleotide
cctgtgcctcggaggcagacagtggggaggaagaatgccggtcacagccc

SEQ ID NO: 2986 - DNA, 100 bp, Artificial Sequence
  Description of Artificial Sequence: Synthetic polynucleotide
gcaggagctggctgcggagcggcgagggacctcgcagggagccatccgatgtgagtgcttccctgggcacctgggctaagcagggatggggaatgtgggc

SEQ ID NO: 2987 - DNA, 50 bp, Artificial Sequence
  Description of Artificial Sequence: Synthetic oligonucleotide
agctggctgcggagcggcgagggacctcgcagggagccatccgatgtgag

SEQ ID NO: 2988 - DNA, 50 bp, Artificial Sequence
  Description of Artificial Sequence: Synthetic oligonucleotide
agctggctgcggagcggcgagggacctcgcagggagccgtccgatgtgag

SEQ ID NO: 2989 - DNA, 50 bp, Artificial Sequence; identical to SEQ ID NO: 2987
  Description of Artificial Sequence: Synthetic oligonucleotide

SEQ ID NO: 2990 - DNA, 50 bp, Artificial Sequence
  Description of Artificial Sequence: Synthetic oligonucleotide
ggctgcggagcggcgagggacctcgcagggagccatccgatgtgagtgct

SEQ ID NO: 2991 - DNA, 50 bp, Artificial Sequence
  Description of Artificial Sequence: Synthetic oligonucleotide
gcggagcggcgagggacctcgcagggagccatccgatgtgagtgcttccc

SEQ ID NO: 2992 - DNA, 50 bp, Artificial Sequence; identical to SEQ ID NO: 2991
  Description of Artificial Sequence: Synthetic oligonucleotide

SEQ ID NO: 2993 - DNA, 50 bp, Artificial Sequence; identical to SEQ ID NO: 2991
  Description of Artificial Sequence: Synthetic oligonucleotide

SEQ ID NO: 2994 - DNA, 50 bp, Artificial Sequence
  Description of Artificial Sequence: Synthetic oligonucleotide
cgcagggagccatccgatgtgagtgcttccttgggcacctgggctaagca

SEQ ID NO: 2995 - DNA, 100 bp, Artificial Sequence
  Description of Artificial Sequence: Synthetic polynucleotide
gatatgaaacctcaggttttaattttttttttcattttctgtctatacaggaggcagacagtggggaggaagaatgccggtcacagcccaggaggtatgt

SEQ ID NO: 2996 - DNA, 100 bp, Artificial Sequence; identical to SEQ ID NO: 2000
  Description of Artificial Sequence: Synthetic polynucleotide

SEQ ID NO: 2997 - DNA, 50 bp, Artificial Sequence
  Description of Artificial Sequence: Synthetic oligonucleotide
gaaactgacattatttggaaaatctacttcctcatcaagcacccctacag

SEQ ID NO: 2998 - DNA, 100 bp, Artificial Sequence; identical to SEQ ID NO: 2004
  Description of Artificial Sequence: Synthetic polynucleotide

SEQ ID NO: 2999 - DNA, 100 bp, Artificial Sequence; identical to SEQ ID NO: 2005
  Description of Artificial Sequence: Synthetic polynucleotide

SEQ ID NO: 3000 - DNA, 100 bp, Artificial Sequence; identical to SEQ ID NO: 2006
  Description of Artificial Sequence: Synthetic polynucleotide

SEQ ID NO: 3001 - DNA, 100 bp, Artificial Sequence; identical to SEQ ID NO: 2007
  Description of Artificial Sequence: Synthetic polynucleotide

SEQ ID NO: 3002 - DNA, 100 bp, Artificial Sequence
  Description of Artificial Sequence: Synthetic polynucleotide
cgccgccgccgctccgccatggggaagcgacagcaccaaaaggacaaaatattctccagctatgtatcgggaaccatgatctatttatgaggagaaggaa

SEQ ID NO: 3003 - DNA, 49 bp, Artificial Sequence
  Description of Artificial Sequence: Synthetic oligonucleotide
aagcgacagcaccaaaaggacaaaatattctccagctatgtatcgggaa

SEQ ID NO: 3004 - DNA, 49 bp, Artificial Sequence; identical to SEQ ID NO: 3003
  Description of Artificial Sequence: Synthetic oligonucleotide

SEQ ID NO: 3005 - DNA, 50 bp, Artificial Sequence
  Description of Artificial Sequence: Synthetic oligonucleotide
agcaccaaaaggacaaaatattctccagctatgtatcgggaaccatgatc

SEQ ID NO: 3006 - DNA, 100 bp, Artificial Sequence
  Description of Artificial Sequence: Synthetic polynucleotide
cgccgccgccgctccgccatggggaagcgacagcaccaaaaggacaaaatgtacattacctgtgctgaatacactcacttttatggtggcaagaagccag

SEQ ID NO: 3007 - DNA, 48 bp, Artificial Sequence
  Description of Artificial Sequence: Synthetic oligonucleotide
catggggaagcgacagcaccaaaaggacaaaatgtacattacctgtgc

SEQ ID NO: 3008 - DNA, 50 bp, Artificial Sequence
  Description of Artificial Sequence: Synthetic oligonucleotide
tggggaagcgacagcaccaaaaggacaaaatgtacattacctgtgctgaa

SEQ ID NO: 3009 - DNA, 100 bp, Artificial Sequence
  Description of Artificial Sequence: Synthetic polynucleotide
aaattgatgtcttcaagtttaactcctcaaagcttcgtgttaataagctgattctccagctatgtatcgggaaccatgatctatttatgaggagaaggaa

SEQ ID NO: 3010 - DNA, 100 bp, Artificial Sequence
  Description of Artificial Sequence: Synthetic polynucleotide
cgccgccgccgctccgccatggggaagcgacagcaccaaaaggacaaaatgtaagttgagccgcagtcgggagcggcgctccactctgcctcagtgaacc

SEQ ID NO: 3011 - DNA, 100 bp, Artificial Sequence
  Description of Artificial Sequence: Synthetic polynucleotide
tgaagtaaatttgtggatattaacctttttgtctgcttctgtggccacagattctccagctatgtatcgggaaccatgatctatttatgaggagaaggaa

SEQ ID NO: 3012 - DNA, 50 bp, Artificial Sequence
  Description of Artificial Sequence: Synthetic oligonucleotide
ggccacagattctccagctatgtatcgggaaccatgatctatttatgagg

SEQ ID NO: 3013 - DNA, 100 bp, Artificial Sequence
  Description of Artificial Sequence: Synthetic polynucleotide
catttgtgggaacagtgtgttcaaggagccacgcaggcgggattaatgtgaaggggaacacggccctgcacatcgctgctctagccgggcaggatgaggt

SEQ ID NO: 3014 - DNA, 50 bp, Artificial Sequence
  Description of Artificial Sequence: Synthetic oligonucleotide
cgcaggcgggattaatgtgaaggggaacacggccctgcacatcgctgctc

SEQ ID NO: 3015 - DNA, 50 bp, Artificial Sequence; identical to SEQ ID NO: 3014
  Description of Artificial Sequence: Synthetic oligonucleotide

SEQ ID NO: 3016 - DNA, 50 bp, Artificial Sequence; identical to SEQ ID NO: 3014
  Description of Artificial Sequence: Synthetic oligonucleotide

SEQ ID NO: 3017 - DNA, 50 bp, Artificial Sequence; identical to SEQ ID NO: 3014
  Description of Artificial Sequence: Synthetic oligonucleotide

SEQ ID NO: 3018 - DNA, 50 bp, Artificial Sequence; identical to SEQ ID NO: 3014
  Description of Artificial Sequence: Synthetic oligonucleotide

SEQ ID NO: 3019 - DNA, 50 bp, Artificial Sequence; identical to SEQ ID NO: 3014
  Description of Artificial Sequence: Synthetic oligonucleotide

SEQ ID NO: 3020 - DNA, 50 bp, Artificial Sequence; identical to SEQ ID NO: 3014
  Description of Artificial Sequence: Synthetic oligonucleotide

SEQ ID NO: 3021 - DNA, 100 bp, Artificial Sequence
  Description of Artificial Sequence: Synthetic polynucleotide
catttgtgggaacagtgtgttcaaggagccacgcaggcgggattaatgtgtttggacaaatcactgtggagacatttgcttccattgttgctcatgaatt

SEQ ID NO: 3022 - DNA, 50 bp, Artificial Sequence
  Description of Artificial Sequence: Synthetic oligonucleotide
cgcaggcgggattaatgtgtttggacaaatcactgtggagacatttgctt

SEQ ID NO: 3023 - DNA, 50 bp, Artificial Sequence; identical to SEQ ID NO: 3022
  Description of Artificial Sequence: Synthetic oligonucleotide

SEQ ID NO: 3024 - DNA, 50 bp, Artificial Sequence; identical to SEQ ID NO: 3022
  Description of Artificial Sequence: Synthetic oligonucleotide

SEQ ID NO: 3025 - DNA, 50 bp, Artificial Sequence; identical to SEQ ID NO: 3022
  Description of Artificial Sequence: Synthetic oligonucleotide

SEQ ID NO: 3026 - DNA, 50 bp, Artificial Sequence; identical to SEQ ID NO: 3022
  Description of Artificial Sequence: Synthetic oligonucleotide

SEQ ID NO: 3027 - DNA, 50 bp, Artificial Sequence; identical to SEQ ID NO: 3022
  Description of Artificial Sequence: Synthetic oligonucleotide

SEQ ID NO: 3028 - DNA, 50 bp, Artificial Sequence; identical to SEQ ID NO: 3022
  Description of Artificial Sequence: Synthetic oligonucleotide

SEQ ID NO: 3029 - DNA, 50 bp, Artificial Sequence; identical to SEQ ID NO: 3022
  Description of Artificial Sequence: Synthetic oligonucleotide

SEQ ID NO: 3030 - DNA, 50 bp, Artificial Sequence; identical to SEQ ID NO: 3022
  Description of Artificial Sequence: Synthetic oligonucleotide

SEQ ID NO: 3031 - DNA, 50 bp, Artificial Sequence; identical to SEQ ID NO: 3022
  Description of Artificial Sequence: Synthetic oligonucleotide

SEQ ID NO: 3032 - DNA, 50 bp, Artificial Sequence; identical to SEQ ID NO: 3022
  Description of Artificial Sequence: Synthetic oligonucleotide

SEQ ID NO: 3033 - DNA, 50 bp, Artificial Sequence
  Description of Artificial Sequence: Synthetic oligonucleotide
gcaggcgggattaatgtgtttggacaaatcactgtggagacatttgcttc

SEQ ID NO: 3034 - DNA, 50 bp, Artificial Sequence; identical to SEQ ID NO: 3033
  Description of Artificial Sequence: Synthetic oligonucleotide

SEQ ID NO: 3035 - DNA, 50 bp, Artificial Sequence; identical to SEQ ID NO: 3033
  Description of Artificial Sequence: Synthetic oligonucleotide

SEQ ID NO: 3036 - DNA, 50 bp, Artificial Sequence; identical to SEQ ID NO: 3033
  Description of Artificial Sequence: Synthetic oligonucleotide

SEQ ID NO: 3037 - DNA, 50 bp, Artificial Sequence; identical to SEQ ID NO: 3033
  Description of Artificial Sequence: Synthetic oligonucleotide

SEQ ID NO: 3038 - DNA, 50 bp, Artificial Sequence; identical to SEQ ID NO: 3033
  Description of Artificial Sequence: Synthetic oligonucleotide

SEQ ID NO: 3039 - DNA, 49 bp, Artificial Sequence
  Description of Artificial Sequence: Synthetic oligonucleotide
caggcgggattaatgtgtttggacaaatcactgtggagacatttgcttc

SEQ ID NO: 3040 - DNA, 49 bp, Artificial Sequence; identical to SEQ ID NO: 3039
  Description of Artificial Sequence: Synthetic oligonucleotide

SEQ ID NO: 3041 - DNA, 50 bp, Artificial Sequence
  Description of Artificial Sequence: Synthetic oligonucleotide
caggcgggattaatgtgtttggacaaatcactgtggagacatttgcttcc

SEQ ID NO: 3042 - DNA, 50 bp, Artificial Sequence; identical to SEQ ID NO: 3041
  Description of Artificial Sequence: Synthetic oligonucleotide

SEQ ID NO: 3043 - DNA, 50 bp, Artificial Sequence; identical to SEQ ID NO: 3041
  Description of Artificial Sequence: Synthetic oligonucleotide

SEQ ID NO: 3044 - DNA, 50 bp, Artificial Sequence; identical to SEQ ID NO: 3041
  Description of Artificial Sequence: Synthetic oligonucleotide

SEQ ID NO: 3045 - DNA, 50 bp, Artificial Sequence; identical to SEQ ID NO: 3041
  Description of Artificial Sequence: Synthetic oligonucleotide

SEQ ID NO: 3046 - DNA, 50 bp, Artificial Sequence; identical to SEQ ID NO: 3041
  Description of Artificial Sequence: Synthetic oligonucleotide

SEQ ID NO: 3047 - DNA, 50 bp, Artificial Sequence; identical to SEQ ID NO: 3041
  Description of Artificial Sequence: Synthetic oligonucleotide

SEQ ID NO: 3048 - DNA, 49 bp, Artificial Sequence
  Description of Artificial Sequence: Synthetic oligonucleotide
gcgggattaatgtgtttggacaaatcactgtggagacatttgcttccat

SEQ ID NO: 3049 - DNA, 49 bp, Artificial Sequence; identical to SEQ ID NO: 3048
  Description of Artificial Sequence: Synthetic oligonucleotide

SEQ ID NO: 3050 - DNA, 49 bp, Artificial Sequence; identical to SEQ ID NO: 3048
  Description of Artificial Sequence: Synthetic oligonucleotide

SEQ ID NO: 3051 - DNA, 49 bp, Artificial Sequence; identical to SEQ ID NO: 3048
  Description of Artificial Sequence: Synthetic oligonucleotide

SEQ ID NO: 3052 - DNA, 50 bp, Artificial Sequence
  Description of Artificial Sequence: Synthetic oligonucleotide
cgggattaatgtgtttggacaaatcactgtggagacatttgcttccattg

SEQ ID NO: 3053 - DNA, 50 bp, Artificial Sequence; identical to SEQ ID NO: 3052
  Description of Artificial Sequence: Synthetic oligonucleotide

SEQ ID NO: 3054 - DNA, 50 bp, Artificial Sequence; identical to SEQ ID NO: 3052
  Description of Artificial Sequence: Synthetic oligonucleotide

SEQ ID NO: 3055 - DNA, 50 bp, Artificial Sequence; identical to SEQ ID NO: 3052
  Description of Artificial Sequence: Synthetic oligonucleotide

SEQ ID NO: 3056 - DNA, 50 bp, Artificial Sequence; identical to SEQ ID NO: 3052
  Description of Artificial Sequence: Synthetic oligonucleotide

SEQ ID NO: 3057 - DNA, 50 bp, Artificial Sequence; identical to SEQ ID NO: 3052
  Description of Artificial Sequence: Synthetic oligonucleotide

SEQ ID NO: 3058 - DNA, 50 bp, Artificial Sequence; identical to SEQ ID NO: 3052
  Description of Artificial Sequence: Synthetic oligonucleotide

SEQ ID NO: 3059 - DNA, 50 bp, Artificial Sequence; identical to SEQ ID NO: 3052
  Description of Artificial Sequence: Synthetic oligonucleotide

SEQ ID NO: 3060 - DNA, 50 bp, Artificial Sequence; identical to SEQ ID NO: 3052
  Description of Artificial Sequence: Synthetic oligonucleotide

SEQ ID NO: 3061 - DNA, 50 bp, Artificial Sequence; identical to SEQ ID NO: 3052
  Description of Artificial Sequence: Synthetic oligonucleotide

SEQ ID NO: 3062 - DNA, 50 bp, Artificial Sequence; identical to SEQ ID NO: 3052
  Description of Artificial Sequence: Synthetic oligonucleotide

SEQ ID NO: 3063 - DNA, 50 bp, Artificial Sequence; identical to SEQ ID NO: 3052
  Description of Artificial Sequence: Synthetic oligonucleotide

SEQ ID NO: 3064 - DNA, 50 bp, Artificial Sequence; identical to SEQ ID NO: 3052
  Description of Artificial Sequence: Synthetic oligonucleotide

SEQ ID NO: 3065 - DNA, 50 bp, Artificial Sequence; identical to SEQ ID NO: 3052
  Description of Artificial Sequence: Synthetic oligonucleotide

SEQ ID NO: 3066 - DNA, 50 bp, Artificial Sequence; identical to SEQ ID NO: 3052
  Description of Artificial Sequence: Synthetic oligonucleotide

SEQ ID NO: 3067 - DNA, 50 bp, Artificial Sequence; identical to SEQ ID NO: 3052
  Description of Artificial Sequence: Synthetic oligonucleotide

SEQ ID NO: 3068 - DNA, 100 bp, Artificial Sequence
  Description of Artificial Sequence: Synthetic polynucleotide
tggtggttgaacttctgcacaaagaaatcattctagaaacgacaaccaagaaggggaacacggccctgcacatcgctgctctagccgggcaggatgaggt

SEQ ID NO: 3069 - DNA, 100 bp, Artificial Sequence
  Description of Artificial Sequence: Synthetic polynucleotide
catttgtgggaacagtgtgttcaaggagccacgcaggcgggattaatgtggtacgttgttcttgatgtttaactttggatgtttgcactgggacaatatc

SEQ ID NO: 3070 - DNA, 50 bp, Artificial Sequence
  Description of Artificial Sequence: Synthetic oligonucleotide
ggcgggattaatgtggtacgttgttcttgatgtttaactttggatgtttg

SEQ ID NO: 3071 - DNA, 100 bp, Artificial Sequence
  Description of Artificial Sequence: Synthetic polynucleotide
agcgggcccagtgggaaaccgcctctgttcccttcccccatgtgtttcagaaggggaacacggccctgcacatcgctgctctagccgggcaggatgaggt

SEQ ID NO: 3072 - DNA, 100 bp, Artificial Sequence
  Description of Artificial Sequence: Synthetic polynucleotide
cggggagaaggactgcgagggtggagcggatgaggccggctgtgctacctgctatattcccaaagcttggattagcactgctatgaaccttcacatagat

SEQ ID NO: 3073 - DNA, 50 bp, Artificial Sequence
  Description of Artificial Sequence: Synthetic oligonucleotide
cgagggtggagcggatgaggccggctgtgctacctgctatattcccaaag

SEQ ID NO: 3074 - DNA, 50 bp, Artificial Sequence
  Description of Artificial Sequence: Synthetic oligonucleotide
ccggctgtgctacctgctatattcccaaagcttggattagcactgctatg

SEQ ID NO: 3075 - DNA, 100 bp, Artificial Sequence
  Description of Artificial Sequence: Synthetic polynucleotide
cggggagaaggactgcgagggtggagcggatgaggccggctgtgctaccttgtgcgccccgcacgagttccagtgcggcaaccgctcgtgcctggccgcc

SEQ ID NO: 3076 - DNA, 100 bp, Artificial Sequence
  Description of Artificial Sequence: Synthetic polynucleotide
ggaatcactgttcctggttagaaatttctgcattttatattattttcttggctatattcccaaagcttggattagcactgctatgaaccttcacatagat

SEQ ID NO: 3077 - DNA, 50 bp, Artificial Sequence
  Description of Artificial Sequence: Synthetic oligonucleotide
cctggttagaaatttctgcattttatattattttcttggctataatccca

SEQ ID NO: 3078 - DNA, 50 bp, Artificial Sequence; identical to SEQ ID NO: 3077
  Description of Artificial Sequence: Synthetic oligonucleotide

SEQ ID NO: 3079 - DNA, 100 bp, Artificial Sequence
  Description of Artificial Sequence: Synthetic polynucleotide
cggggagaaggactgcgagggtggagcggatgaggccggctgtgctacctgtgagtctggggtcagatctccagggtctgccaagcatggtcaggcagcc

SEQ ID NO: 3080 - DNA, 50 bp, Artificial Sequence
  Description of Artificial Sequence: Synthetic oligonucleotide
gtgctacctgtgagtctggggtcagatctccagggtctgccaagcatggt

SEQ ID NO: 3081 - DNA, 100 bp, Artificial Sequence
  Description of Artificial Sequence: Synthetic polynucleotide
acttgttttataactttttatgttcatagcttggtattttttcccttcaggctatattcccaaagcttggattagcactgctatgaaccttcacatagat

SEQ ID NO: 3082 - DNA, 100 bp, Artificial Sequence
  Description of Artificial Sequence: Synthetic polynucleotide
ttcagtggcttgcctgcggttgagaaaaggaggaaaatggtcaccttgggatacatcaagaaatctggaatttcatgaaatacatagtactgggaatgaa

SEQ ID NO: 3083 - DNA, 50 bp, Artificial Sequence
  Description of Artificial Sequence: Synthetic oligonucleotide
ggcttgcctgcggttgagaaaaggaggaaaatggtcaccttgggatacat

SEQ ID NO: 3084 - DNA, 49 bp, Artificial Sequence
  Description of Artificial Sequence: Synthetic oligonucleotide
ggcttgcctgcggttgagaaaaggaggaaaatggtcaccttgggataca

SEQ ID NO: 3085 - DNA, 50 bp, Artificial Sequence
  Description of Artificial Sequence: Synthetic oligonucleotide
tgcctgcggttgagaaaaggaggaaaatggtcaccttgggatacatcaag

SEQ ID NO: 3086 - DNA, 50 bp, Artificial Sequence; identical to SEQ ID NO: 3085
  Description of Artificial Sequence: Synthetic oligonucleotide

SEQ ID NO: 3087 - DNA, 50 bp, Artificial Sequence; identical to SEQ ID NO: 3085
  Description of Artificial Sequence: Synthetic oligonucleotide

SEQ ID NO: 3088 - DNA, 50 bp, Artificial Sequence; identical to SEQ ID NO: 3085
  Description of Artificial Sequence: Synthetic oligonucleotide

SEQ ID NO: 3089 - DNA, 50 bp, Artificial Sequence; identical to SEQ ID NO: 3085
  Description of Artificial Sequence: Synthetic oligonucleotide

SEQ ID NO: 3090 - DNA, 50 bp, Artificial Sequence; identical to SEQ ID NO: 3085
  Description of Artificial Sequence: Synthetic oligonucleotide

SEQ ID NO: 3091 - DNA, 50 bp, Artificial Sequence; identical to SEQ ID NO: 3085
  Description of Artificial Sequence: Synthetic oligonucleotide

SEQ ID NO: 3092 - DNA, 50 bp, Artificial Sequence; identical to SEQ ID NO: 3085
  Description of Artificial Sequence: Synthetic oligonucleotide

SEQ ID NO: 3093 - DNA, 50 bp, Artificial Sequence; identical to SEQ ID NO: 3085
  Description of Artificial Sequence: Synthetic oligonucleotide

SEQ ID NO: 3094 - DNA, 48 bp, Artificial Sequence
  Description of Artificial Sequence: Synthetic oligonucleotide
tgcctgcggttgagaaaaggaggaaaatggtcaccttgggatacatca

SEQ ID NO: 3095 - DNA, 49 bp, Artificial Sequence
  Description of Artificial Sequence: Synthetic oligonucleotide
gcctgcggttgagaaaaggaggaaaatggtcaccttgggatacatcaag

SEQ ID NO: 3096 - DNA, 50 bp, Artificial Sequence
  Description of Artificial Sequence: Synthetic oligonucleotide
gcggttgagaaaaggaggaaaatggtcaccttgggatacatcaagaaatc

SEQ ID NO: 3097 - DNA, 49 bp, Artificial Sequence
  Description of Artificial Sequence: Synthetic oligonucleotide
gaggaaaatggtcaccttgggatacatcaagaaatctggaatttcatga

SEQ ID NO: 3098 - DNA, 49 bp, Artificial Sequence; identical to SEQ ID NO: 3097
  Description of Artificial Sequence: Synthetic oligonucleotide

SEQ ID NO: 3099 - DNA, 49 bp, Artificial Sequence; identical to SEQ ID NO: 3097
  Description of Artificial Sequence: Synthetic oligonucleotide

SEQ ID NO: 3100 - DNA, 50 bp, Artificial Sequence
  Description of Artificial Sequence: Synthetic oligonucleotide
ggtcaccttgggatacatcaagaaatctggaatttcatgaaatacatagt

SEQ ID NO: 3101 - DNA, 50 bp, Artificial Sequence; identical to SEQ ID NO: 3100
  Description of Artificial Sequence: Synthetic oligonucleotide

SEQ ID NO: 3102 - DNA, 100 bp, Artificial Sequence
  Description of Artificial Sequence: Synthetic polynucleotide
ttcagtggcttgcctgcggttgagaaaaggaggaaaatggtcaccttgggggctaatgctaaaggaggtcatctggaaggactgcagatgactgatttgg

SEQ ID NO: 3103 - DNA, 100 bp, Artificial Sequence
  Description of Artificial Sequence: Synthetic polynucleotide
agaaaaggagaaaatagtctgggtcagatttgaaaatgcagatttaaatgatacatcaagaaatctggaatttcatgaaatacatagtactgggaatgaa

SEQ ID NO: 3104 - DNA, 100 bp, Artificial Sequence
  Description of Artificial Sequence: Synthetic polynucleotide
ttcagtggcttgcctgcggttgagaaaaggaggaaaatggtcaccttggggtaaattaagttgttttgtatatgtaatggtataatagctaatagctttg

SEQ ID NO: 3105 - DNA, 100 bp, Artificial Sequence
  Description of Artificial Sequence: Synthetic polynucleotide
tgccattatgtcttttaaatttgcttctttgttacttaattctaatgcagatacatcaagaaatctggaatttcatgaaatacatagtactgggaatgaa

SEQ ID NO: 3106 - DNA, 100 bp, Artificial Sequence
  Description of Artificial Sequence: Synthetic polynucleotide
ccctggagaaaatagtcgttcaaagggagactgtcagactctgtctgaagatacatcaagaaatctggaatttcatgaaatacatagtactgggaatgaa

SEQ ID NO: 3107 - DNA, 50 bp, Artificial Sequence
  Description of Artificial Sequence: Synthetic oligonucleotide
aagggagactgtcagactctgtctgaagatacatcaagaaatctggaatt

SEQ ID NO: 3108 - DNA, 100 bp, Artificial Sequence
  Description of Artificial Sequence: Synthetic polynucleotide
ccctggagaaaatagtcgttcaaagggagactgtcagactctgtctgaaggctccccaggaagctctcagtctgggagcaggcacagttctccccgagcc

SEQ ID NO: 3109 - DNA, 50 bp, Artificial Sequence
  Description of Artificial Sequence: Synthetic oligonucleotide
agactctgtctgaaggctcctcaggaagctctcagtctgggagcaggcac

SEQ ID NO: 3110 - DNA, 50 bp, Artificial Sequence; identical to SEQ ID NO: 3109
  Description of Artificial Sequence: Synthetic oligonucleotide

SEQ ID NO: 3111 - DNA, 50 bp, Artificial Sequence; identical to SEQ ID NO: 3109
  Description of Artificial Sequence: Synthetic oligonucleotide

SEQ ID NO: 3112 - DNA, 50 bp, Artificial Sequence; identical to SEQ ID NO: 3109
  Description of Artificial Sequence: Synthetic oligonucleotide

SEQ ID NO: 3113 - DNA, 100 bp, Artificial Sequence; identical to SEQ ID NO: 3103
  Description of Artificial Sequence: Synthetic polynucleotide

SEQ ID NO: 3114 - DNA, 100 bp, Artificial Sequence
  Description of Artificial Sequence: Synthetic polynucleotide
ccctggagaaaatagtcgttcaaagggagactgtcagactctgtctgaaggtaaatttgagggattcagaatgtacttttagtggggtaaatatttatta

SEQ ID NO: 3115 - DNA, 100 bp, Artificial Sequence; identical to SEQ ID NO: 3105
  Description of Artificial Sequence: Synthetic polynucleotide

SEQ ID NO: 3116 - DNA, 100 bp, Artificial Sequence
  Description of Artificial Sequence: Synthetic polynucleotide
ttttgtgaattggaagtttttgctaaagtactgagagctttggataaaaggtgaagcagaacctcctgaacgtctcctaccacatcgcccagtacaccag

SEQ ID NO: 3117 - DNA, 50 bp, Artificial Sequence
  Description of Artificial Sequence: Synthetic oligonucleotide
gagagctttggataaaaggtgaagcagaatctcctgaacgtctcctacca

SEQ ID NO: 3118 - DNA, 100 bp, Artificial Sequence
  Description of Artificial Sequence: Synthetic polynucleotide
ttttgtgaattggaagtttttgctaaagtactgagagctttggataaaagacatttgcttcatcattgttttcaggctttgatggatcatggtgttaaag

SEQ ID NO: 3119 - DNA, 50 bp, Artificial Sequence
  Description of Artificial Sequence: Synthetic oligonucleotide
gagagctttggataaaagacatttgcttcatcattgttttcaggctttga

SEQ ID NO: 3120 - DNA, 50 bp, Artificial Sequence; identical to SEQ ID NO: 3119
  Description of Artificial Sequence: Synthetic oligonucleotide

SEQ ID NO: 3121 - DNA, 50 bp, Artificial Sequence; identical to SEQ ID NO: 3119
  Description of Artificial Sequence: Synthetic oligonucleotide

SEQ ID NO: 3122 - DNA, 50 bp, Artificial Sequence; identical to SEQ ID NO: 3119
  Description of Artificial Sequence: Synthetic oligonucleotide

SEQ ID NO: 3123 - DNA, 50 bp, Artificial Sequence; identical to SEQ ID NO: 3119
  Description of Artificial Sequence: Synthetic oligonucleotide

SEQ ID NO: 3124 - DNA, 50 bp, Artificial Sequence; identical to SEQ ID NO: 3119
  Description of Artificial Sequence: Synthetic oligonucleotide

SEQ ID NO: 3125 - DNA, 50 bp, Artificial Sequence; identical to SEQ ID NO: 3119
  Description of Artificial Sequence: Synthetic oligonucleotide

SEQ ID NO: 3126 - DNA, 100 bp, Artificial Sequence
  Description of Artificial Sequence: Synthetic polynucleotide
cccggaacaccctgacctacgccggccgggccaagaacattaagactagggtgaagcagaacctcctgaacgtctcctaccacatcgcccagtacaccag

SEQ ID NO: 3127 - DNA, 100 bp, Artificial Sequence
  Description of Artificial Sequence: Synthetic polynucleotide
ttttgtgaattggaagtttttgctaaagtactgagagctttggataaaaggtaaattcttttttaaaaaattgtaaaatatacataacataaaatttacc

SEQ ID NO: 3128 - DNA, 50 bp, Artificial Sequence
  Description of Artificial Sequence: Synthetic oligonucleotide
gagagctttggataaaaggtaaattcttttttaaaaaattgtaaaatata

SEQ ID NO: 3129 - DNA, 100 bp, Artificial Sequence
  Description of Artificial Sequence: Synthetic polynucleotide
gtgcacctggggtgactgcatcccctccgctccatacgtgttccctgcaggtgaagcagaacctcctgaacgtctcctaccacatcgcccagtacaccag

SEQ ID NO: 3130 - DNA, 100 bp, Artificial Sequence
  Description of Artificial Sequence: Synthetic polynucleotide
gatgacctcggacacttcaggcatctgcaacctccgtggcagtaagaaagggcttatttcaaaacctttgtccctcagttccaggaggcagcatttgcca

SEQ ID NO: 3131 - DNA, 50 bp, Artificial Sequence
  Description of Artificial Sequence: Synthetic oligonucleotide
cggacacttcaggcatctgcaacctccgtggcagtaagaaagggcttatt

SEQ ID NO: 3132 - DNA, 50 bp, Artificial Sequence; identical to SEQ ID NO: 3131
  Description of Artificial Sequence: Synthetic oligonucleotide

SEQ ID NO: 3133 - DNA, 49 bp, Artificial Sequence
  Description of Artificial Sequence: Synthetic oligonucleotide
cggacacttcaggcatctgcaacctccgtggcagtaagaaagggcttat

SEQ ID NO: 3134 - DNA, 50 bp, Artificial Sequence; identical to SEQ ID NO: 3131
  Description of Artificial Sequence: Synthetic oligonucleotide

SEQ ID NO: 3135 - DNA, 50 bp, Artificial Sequence; identical to SEQ ID NO: 3131
  Description of Artificial Sequence: Synthetic oligonucleotide

SEQ ID NO: 3136 - DNA, 50 bp, Artificial Sequence
  Description of Artificial Sequence: Synthetic oligonucleotide
ccgtggcagtaagaaagggcttatttcaaaacctttgtccctcagttcca

SEQ ID NO: 3137 - DNA, 50 bp, Artificial Sequence; identical to SEQ ID NO: 3136
  Description of Artificial Sequence: Synthetic oligonucleotide

SEQ ID NO: 3138 - DNA, 47 bp, Artificial Sequence
  Description of Artificial Sequence: Synthetic oligonucleotide
ccgtggcagtaagaaagggcttatttcaaaacctttgtccctcagtt

SEQ ID NO: 3139 - DNA, 50 bp, Artificial Sequence; identical to SEQ ID NO: 3136
  Description of Artificial Sequence: Synthetic oligonucleotide

SEQ ID NO: 3140 - DNA, 50 bp, Artificial Sequence
  Description of Artificial Sequence: Synthetic oligonucleotide
ccgtggcagtaagaaagggcttattccaaaacctttgtccctcagttcca

SEQ ID NO: 3141 - DNA, 50 bp, Artificial Sequence; identical to SEQ ID NO: 3136
  Description of Artificial Sequence: Synthetic oligonucleotide

SEQ ID NO: 3142 - DNA, 50 bp, Artificial Sequence; identical to SEQ ID NO: 3136
  Description of Artificial Sequence: Synthetic oligonucleotide

SEQ ID NO: 3143 - DNA, 50 bp, Artificial Sequence; identical to SEQ ID NO: 3136
  Description of Artificial Sequence: Synthetic oligonucleotide

SEQ ID NO: 3144 - DNA, 50 bp, Artificial Sequence; identical to SEQ ID NO: 3136
  Description of Artificial Sequence: Synthetic oligonucleotide

SEQ ID NO: 3145 - DNA, 47 bp, Artificial Sequence; identical to SEQ ID NO: 3138
  Description of Artificial Sequence: Synthetic oligonucleotide

SEQ ID NO: 3146 - DNA, 50 bp, Artificial Sequence; identical to SEQ ID NO: 3136
  Description of Artificial Sequence: Synthetic oligonucleotide

SEQ ID NO: 3147 - DNA, 47 bp, Artificial Sequence; identical to SEQ ID NO: 3138
  Description of Artificial Sequence: Synthetic oligonucleotide

SEQ ID NO: 3148 - DNA, 50 bp, Artificial Sequence
  Description of Artificial Sequence: Synthetic oligonucleotide
gtggcagtaagaaagggcttatttcaaaacctttgtccctcagttccagg

SEQ ID NO: 3149 - DNA, 50 bp, Artificial Sequence
  Description of Artificial Sequence: Synthetic oligonucleotide
tggcagtaagaaagggcttatttcaaaacctttgtccctcagttccagga

SEQ ID NO: 3150 - DNA, 50 bp, Artificial Sequence
  Description of Artificial Sequence: Synthetic oligonucleotide
tggcagtaagaaagggcttatttcaaaacctttgtcccttagttccagga

SEQ ID NO: 3151 - DNA, 50 bp, Artificial Sequence; identical to SEQ ID NO: 3150
  Description of Artificial Sequence: Synthetic oligonucleotide

SEQ ID NO: 3152 - DNA, 50 bp, Artificial Sequence; identical to SEQ ID NO: 3149
  Description of Artificial Sequence: Synthetic oligonucleotide

SEQ ID NO: 3153 - DNA, 50 bp, Artificial Sequence; identical to SEQ ID NO: 3149
  Description of Artificial Sequence: Synthetic oligonucleotide

SEQ ID NO: 3154 - DNA, 50 bp, Artificial Sequence; identical to SEQ ID NO: 3149
  Description of Artificial Sequence: Synthetic oligonucleotide

SEQ ID NO: 3155 - DNA, 50 bp, Artificial Sequence
  Description of Artificial Sequence: Synthetic oligonucleotide
ggcagtaagaaagggcttatttcaaaacctttgtctctcagttccaggag

SEQ ID NO: 3156 - DNA, 50 bp, Artificial Sequence
  Description of Artificial Sequence: Synthetic oligonucleotide
ggcagtaagaaagggcttatttcaaaacctttgtccctcagttccaggag

SEQ ID NO: 3157 - DNA, 100 bp, Artificial Sequence; identical to SEQ ID NO: 391
  Description of Artificial Sequence: Synthetic polynucleotide

SEQ ID NO: 3158 - DNA, 50 bp, Artificial Sequence
  Description of Artificial Sequence: Synthetic oligonucleotide
ccgtggcggtaagaaagtcaggcccactcccaaaaacatcacggtggtgg

SEQ ID NO: 3159 - DNA, 50 bp, Artificial Sequence
  Description of Artificial Sequence: Synthetic oligonucleotide
gtggcagtaagaaagtcaggcccgctcccaaaaacatcacggtggtggcg

SEQ ID NO: 3160 - DNA, 100 bp, Artificial Sequence
  Description of Artificial Sequence: Synthetic polynucleotide
tggagggcctcagagggagagagaactgctcagtaattttgatcactttgggcttatttcaaaacctttgtccctcagttccaggaggcagcatttgcca

SEQ ID NO: 3161 - DNA, 100 bp, Artificial Sequence; identical to SEQ ID NO: 394
  Description of Artificial Sequence: Synthetic polynucleotide

SEQ ID NO: 3162 - DNA, 50 bp, Artificial Sequence; identical to SEQ ID NO: 395
  Description of Artificial Sequence: Synthetic oligonucleotide

SEQ ID NO: 3163 - DNA, 50 bp, Artificial Sequence; identical to SEQ ID NO: 395
  Description of Artificial Sequence: Synthetic oligonucleotide

SEQ ID NO: 3164 - DNA, 50 bp, Artificial Sequence
  Description of Artificial Sequence: Synthetic oligonucleotide
agtaagaaaggtgagctttttcattcccgtcgcatcgggctgagccctgg

SEQ ID NO: 3165 - DNA, 50 bp, Artificial Sequence
  Description of Artificial Sequence: Synthetic oligonucleotide
aagaaaggtgagctttttcattcccgtcgcatcgggttgagccctggacc

SEQ ID NO: 3166 - DNA, 50 bp, Artificial Sequence; identical to SEQ ID NO: 3165
  Description of Artificial Sequence: Synthetic oligonucleotide

SEQ ID NO: 3167 - DNA, 50 bp, Artificial Sequence; identical to SEQ ID NO: 3165
  Description of Artificial Sequence: Synthetic oligonucleotide

SEQ ID NO: 3168 - DNA, 100 bp, Artificial Sequence
  Description of Artificial Sequence: Synthetic polynucleotide
aagttgtttgtgctaaccacaattttttttctccccttctttcccaccagggcttatttcaaaacctttgtccctcagttccaggaggcagcatttgcca

SEQ ID NO: 3169 - DNA, 100 bp, Artificial Sequence; identical to SEQ ID NO: 2000
  Description of Artificial Sequence: Synthetic polynucleotide

SEQ ID NO: 3170 - DNA, 50 bp, Artificial Sequence
  Description of Artificial Sequence: Synthetic oligonucleotide
agtaggatactgaaactgacattatttggaaaatctacttcctcatcaag

SEQ ID NO: 3171 - DNA, 50 bp, Artificial Sequence; identical to SEQ ID NO: 3170
  Description of Artificial Sequence: Synthetic oligonucleotide

SEQ ID NO: 3172 - DNA, 50 bp, Artificial Sequence
  Description of Artificial Sequence: Synthetic oligonucleotide
aggatactgaaactgacattatttggaaaatctacttcctcatcaagcac

SEQ ID NO: 3173 - DNA, 100 bp, Artificial Sequence; identical to SEQ ID NO: 2004
  Description of Artificial Sequence: Synthetic polynucleotide

SEQ ID NO: 3174 - DNA, 50 bp, Artificial Sequence
  Description of Artificial Sequence: Synthetic oligonucleotide
agtgcagtaggatactgaaactgacattatttgttaatggccagccaaga

SEQ ID NO: 3175 - DNA, 50 bp, Artificial Sequence; identical to SEQ ID NO: 3174
  Description of Artificial Sequence: Synthetic oligonucleotide

SEQ ID NO: 3176 - DNA, 50 bp, Artificial Sequence
  Description of Artificial Sequence: Synthetic oligonucleotide
agtgcagtaggatactgaaactgacattatttgttaatggccaaccaaga

SEQ ID NO: 3177 - DNA, 50 bp, Artificial Sequence
  Description of Artificial Sequence: Synthetic oligonucleotide
ctgaaactgacattatttgttaatggccagccaagaccccttgaatcaag

SEQ ID NO: 3178 - DNA, 100 bp, Artificial Sequence; identical to SEQ ID NO: 2005
  Description of Artificial Sequence: Synthetic polynucleotide

SEQ ID NO: 3179 - DNA, 100 bp, Artificial Sequence; identical to SEQ ID NO: 2006
  Description of Artificial Sequence: Synthetic polynucleotide

SEQ ID NO: 3180 - DNA, 100 bp, Artificial Sequence; identical to SEQ ID NO: 2007
  Description of Artificial Sequence: Synthetic polynucleotide

SEQ ID NO: 3181 - DNA, 100 bp, Artificial Sequence; identical to SEQ ID NO: 2915
  Description of Artificial Sequence: Synthetic polynucleotide

SEQ ID NO: 3182 - DNA, 50 bp, Artificial Sequence
  Description of Artificial Sequence: Synthetic oligonucleotide
gccggctccgcaaatgctacgaagtgggaatgatgaaaggtgttggacag

SEQ ID NO: 3183 - DNA, 50 bp, Artificial Sequence
  Description of Artificial Sequence: Synthetic oligonucleotide
gggaatgatgaaaggtgttggacagagagactctgaagatgtgagcgaaa

SEQ ID NO: 3184 - DNA, 50 bp, Artificial Sequence; identical to SEQ ID NO: 3183
  Description of Artificial Sequence: Synthetic oligonucleotide

SEQ ID NO: 3185 - DNA, 50 bp, Artificial Sequence; identical to SEQ ID NO: 3183
  Description of Artificial Sequence: Synthetic oligonucleotide

SEQ ID NO: 3186 - DNA, 50 bp, Artificial Sequence; identical to SEQ ID NO: 3183
  Description of Artificial Sequence: Synthetic oligonucleotide

SEQ ID NO: 3187 - DNA, 50 bp, Artificial Sequence; identical to SEQ ID NO: 3183
  Description of Artificial Sequence: Synthetic oligonucleotide

SEQ ID NO: 3188 - DNA, 50 bp, Artificial Sequence; identical to SEQ ID NO: 3183
  Description of Artificial Sequence: Synthetic oligonucleotide

SEQ ID NO: 3189 - DNA, 50 bp, Artificial Sequence; identical to SEQ ID NO: 3183
  Description of Artificial Sequence: Synthetic oligonucleotide

SEQ ID NO: 3190 - DNA, 50 bp, Artificial Sequence
  Description of Artificial Sequence: Synthetic oligonucleotide
aaaggtgttggacagagagactctgaagatgtgagcgaaagagactccga

SEQ ID NO: 3191 - DNA, 50 bp, Artificial Sequence; identical to SEQ ID NO: 3190
  Description of Artificial Sequence: Synthetic oligonucleotide

SEQ ID NO: 3192 - DNA, 50 bp, Artificial Sequence; identical to SEQ ID NO: 3190
  Description of Artificial Sequence: Synthetic oligonucleotide

SEQ ID NO: 3193 - DNA, 50 bp, Artificial Sequence; identical to SEQ ID NO: 3190
  Description of Artificial Sequence: Synthetic oligonucleotide

SEQ ID NO: 3194 - DNA, 50 bp, Artificial Sequence; identical to SEQ ID NO: 3190
  Description of Artificial Sequence: Synthetic oligonucleotide

SEQ ID NO: 3195 - DNA, 50 bp, Artificial Sequence; identical to SEQ ID NO: 3190
  Description of Artificial Sequence: Synthetic oligonucleotide

SEQ ID NO: 3196 - DNA, 50 bp, Artificial Sequence; identical to SEQ ID NO: 3190
  Description of Artificial Sequence: Synthetic oligonucleotide

SEQ ID NO: 3197 - DNA, 50 bp, Artificial Sequence; identical to SEQ ID NO: 3190
  Description of Artificial Sequence: Synthetic oligonucleotide

SEQ ID NO: 3198 - DNA, 50 bp, Artificial Sequence; identical to SEQ ID NO: 3190
  Description of Artificial Sequence: Synthetic oligonucleotide

SEQ ID NO: 3199 - DNA, 100 bp, Artificial Sequence; identical to SEQ ID NO: 2921
  Description of Artificial Sequence: Synthetic polynucleotide

SEQ ID NO: 3200 - DNA, 50 bp, Artificial Sequence
  Description of Artificial Sequence: Synthetic oligonucleotide
gtgggaatgatgaaaggtgggatacgaaaagaccgaagaggagggagaat

SEQ ID NO: 3201 - DNA, 50 bp, Artificial Sequence; identical to SEQ ID NO: 3200
  Description of Artificial Sequence: Synthetic oligonucleotide

SEQ ID NO: 3202 - DNA, 50 bp, Artificial Sequence
  Description of Artificial Sequence: Synthetic oligonucleotide
tgggaatgatgaaaggtgggatatgaaaagaccgaagaggagggagaatg

SEQ ID NO: 3203 - DNA, 50 bp, Artificial Sequence; identical to SEQ ID NO: 3202
  Description of Artificial Sequence: Synthetic oligonucleotide

SEQ ID NO: 3204 - DNA, 50 bp, Artificial Sequence
  Description of Artificial Sequence: Synthetic oligonucleotide
gggaatgatgaaaggtgggatacgaaaagaccgaagaggagggagaatgt

SEQ ID NO: 3205 - DNA, 50 bp, Artificial Sequence; identical to SEQ ID NO: 3204
  Description of Artificial Sequence: Synthetic oligonucleotide

SEQ ID NO: 3206 - DNA, 50 bp, Artificial Sequence; identical to SEQ ID NO: 3204
  Description of Artificial Sequence: Synthetic oligonucleotide

SEQ ID NO: 3207 - DNA, 50 bp, Artificial Sequence; identical to SEQ ID NO: 3204
  Description of Artificial Sequence: Synthetic oligonucleotide

SEQ ID NO: 3208 - DNA, 50 bp, Artificial Sequence; identical to SEQ ID NO: 3204
  Description of Artificial Sequence: Synthetic oligonucleotide

SEQ ID NO: 3209 - DNA, 50 bp, Artificial Sequence; identical to SEQ ID NO: 3204
  Description of Artificial Sequence: Synthetic oligonucleotide

SEQ ID NO: 3210 - DNA, 49 bp, Artificial Sequence
  Description of Artificial Sequence: Synthetic oligonucleotide
gggaatgatgaaaggtgggatacgaaaagaccgaagaggagggagaatg

SEQ ID NO: 3211 - DNA, 50 bp, Artificial Sequence; identical to SEQ ID NO: 3204
  Description of Artificial Sequence: Synthetic oligonucleotide

SEQ ID NO: 3212 - DNA, 50 bp, Artificial Sequence; identical to SEQ ID NO: 3204
  Description of Artificial Sequence: Synthetic oligonucleotide

SEQ ID NO: 3213 - DNA, 50 bp, Artificial Sequence; identical to SEQ ID NO: 3204
  Description of Artificial Sequence: Synthetic oligonucleotide

SEQ ID NO: 3214 - DNA, 50 bp, Artificial Sequence; identical to SEQ ID NO: 3204
  Description of Artificial Sequence: Synthetic oligonucleotide

SEQ ID NO: 3215 - DNA, 50 bp, Artificial Sequence; identical to SEQ ID NO: 3204
  Description of Artificial Sequence: Synthetic oligonucleotide

SEQ ID NO: 3216 - DNA, 50 bp, Artificial Sequence; identical to SEQ ID NO: 3204
  Description of Artificial Sequence: Synthetic oligonucleotide

SEQ ID NO: 3217 - DNA, 50 bp, Artificial Sequence; identical to SEQ ID NO: 3204
  Description of Artificial Sequence: Synthetic oligonucleotide

SEQ ID NO: 3218 - DNA, 100 bp, Artificial Sequence; identical to SEQ ID NO: 600
  Description of Artificial Sequence: Synthetic polynucleotide

SEQ ID NO: 3219 - DNA, 100 bp, Artificial Sequence; identical to SEQ ID NO: 2923
  Description of Artificial Sequence: Synthetic polynucleotide

SEQ ID NO: 3220 - DNA, 100 bp, Artificial Sequence; identical to SEQ ID NO: 728
  Description of Artificial Sequence: Synthetic polynucleotide

SEQ ID NO: 3221 - DNA, 100 bp, Artificial Sequence
  Description of Artificial Sequence: Synthetic polynucleotide
aggaacattgaagtactgaatctaaatgggtgtacaaagacaacagacgcgttgtaaacatgttaaaggcatcctgttatatggacccccaggttgtggt

SEQ ID NO: 3222 - DNA, 50 bp, Artificial Sequence
  Description of Artificial Sequence: Synthetic oligonucleotide
aaatgggtgtacaaagacaacagacgcgttgtaaacatgttaaaggcatc

SEQ ID NO: 3223 - DNA, 50 bp, Artificial Sequence; identical to SEQ ID NO: 3222
  Description of Artificial Sequence: Synthetic oligonucleotide

SEQ ID NO: 3224 - DNA, 50 bp, Artificial Sequence
  Description of Artificial Sequence: Synthetic oligonucleotide
cagacgcgttgtaaacatgttaaaggcatcctgttatatggacccccagg

SEQ ID NO: 3225 - DNA, 100 bp, Artificial Sequence
  Description of Artificial Sequence: Synthetic polynucleotide
aggaacattgaagtactgaatctaaatgggtgtacaaagacaacagacgctacatgtactagccttagcaagttctgttccaaactcaggcaccttgact

SEQ ID NO: 3226 - DNA, 50 bp, Artificial Sequence
  Description of Artificial Sequence: Synthetic oligonucleotide
aaatgggtgtacaaagacaacagacgctacatgtactagccttagcaagt

SEQ ID NO: 3227 - DNA, 100 bp, Artificial Sequence
  Description of Artificial Sequence: Synthetic polynucleotide
acgagcatttgcttcccgagtatttcctccagagattgtggagcagatgggttgtaaacatgttaaaggcatcctgttatatggacccccaggttgtggt

SEQ ID NO: 3228 - DNA, 100 bp, Artificial Sequence
  Description of Artificial Sequence: Synthetic polynucleotide
aggaacattgaagtactgaatctaaatgggtgtacaaagacaacagacgcgtaagtattttatgtttttggaggataagtcataaccccttatgtctggc

SEQ ID NO: 3229 - DNA, 50 bp, Artificial Sequence
  Description of Artificial Sequence: Synthetic oligonucleotide
aaatgggtgtacaaagacaacagacgcgtaagtattttatgtttttggag

SEQ ID NO: 3230 - DNA, 50 bp, Artificial Sequence; identical to SEQ ID NO: 3229
  Description of Artificial Sequence: Synthetic oligonucleotide

SEQ ID NO: 3231 - DNA, 50 bp, Artificial Sequence; identical to SEQ ID NO: 3229
  Description of Artificial Sequence: Synthetic oligonucleotide

SEQ ID NO: 3232 - DNA, 50 bp, Artificial Sequence; identical to SEQ ID NO: 3229
  Description of Artificial Sequence: Synthetic oligonucleotide

SEQ ID NO: 3233 - DNA, 50 bp, Artificial Sequence; identical to SEQ ID NO: 3229
  Description of Artificial Sequence: Synthetic oligonucleotide

SEQ ID NO: 3234 - DNA, 50 bp, Artificial Sequence; identical to SEQ ID NO: 3229
  Description of Artificial Sequence: Synthetic oligonucleotide

SEQ ID NO: 3235 - DNA, 50 bp, Artificial Sequence
  Description of Artificial Sequence: Synthetic oligonucleotide
aaatgggtgtacaaagacgacagacgcgtaagtattttatgtttttggag

SEQ ID NO: 3236 - DNA, 50 bp, Artificial Sequence; identical to SEQ ID NO: 3229
  Description of Artificial Sequence: Synthetic oligonucleotide

SEQ ID NO: 3237 - DNA, 50 bp, Artificial Sequence; identical to SEQ ID NO: 3229
  Description of Artificial Sequence: Synthetic oligonucleotide

SEQ ID NO: 3238 - DNA, 49 bp, Artificial Sequence
  Description of Artificial Sequence: Synthetic oligonucleotide
tgggtgtacaaagacaacagacgcgtaagtattttatgtttttggagga

SEQ ID NO: 3239 - DNA, 49 bp, Artificial Sequence
  Description of Artificial Sequence: Synthetic oligonucleotide
gacgcgtaagtattttatgtttttggaggataagtcataaccccttatg

SEQ ID NO: 3240 - DNA, 49 bp, Artificial Sequence; identical to SEQ ID NO: 3239
  Description of Artificial Sequence: Synthetic oligonucleotide

SEQ ID NO: 3241 - DNA, 49 bp, Artificial Sequence; identical to SEQ ID NO: 3239
  Description of Artificial Sequence: Synthetic oligonucleotide

SEQ ID NO: 3242 - DNA, 49 bp, Artificial Sequence; identical to SEQ ID NO: 3239
  Description of Artificial Sequence: Synthetic oligonucleotide

SEQ ID NO: 3243 - DNA, 100 bp, Artificial Sequence
  Description of Artificial Sequence: Synthetic polynucleotide
tacttagattctagttagctgatataagactgttttcttttccttttcaggttgtaaacatgttaaaggcatcctgttatatggacccccaggttgtggt

SEQ ID NO: 3244 - DNA, 100 bp, Artificial Sequence
  Description of Artificial Sequence: Synthetic polynucleotide
gccgtccttcctgccgacgtcggggtggccgttcagcagccgagactcaaaatagcctaacatggcagaccagagacagcgctcactgtctacctctggg

SEQ ID NO: 3245 - DNA, 50 bp, Artificial Sequence
  Description of Artificial Sequence: Synthetic oligonucleotide
ggtggccgttcagcagccgagactcaaaatagcctaacatggcagaccag

SEQ ID NO: 3246 - DNA, 100 bp, Artificial Sequence
  Description of Artificial Sequence: Synthetic polynucleotide
gccgtccttcctgccgacgtcggggtggccgttcagcagccgagactcaaatgcggacctgtccgtcaccgaagccagcagctccgacagccgaggagag

SEQ ID NO: 3247 - DNA, 48 bp, Artificial Sequence
  Description of Artificial Sequence: Synthetic oligonucleotide
cggggtggccgttcagcagccgagactcaaatgcggacctgtccgtca

SEQ ID NO: 3248 - DNA, 49 bp, Artificial Sequence
  Description of Artificial Sequence: Synthetic oligonucleotide
cggggtggccgttcagcagccgagactcaaatgcggacctgtccgtcac

SEQ ID NO: 3249 - DNA, 50 bp, Artificial Sequence
  Description of Artificial Sequence: Synthetic oligonucleotide
gcagccgagactcaaatgcggacctgtccgtcaccgaagccagcagctcc

SEQ ID NO: 3250 - DNA, 100 bp, Artificial Sequence
  Description of Artificial Sequence: Synthetic polynucleotide
agcggagccgcggagccggcgggagggcgggcgggcgggcggacgggcagaatagcctaacatggcagaccagagacagcgctcactgtctacctctggg

SEQ ID NO: 3251 - DNA, 100 bp, Artificial Sequence
  Description of Artificial Sequence: Synthetic polynucleotide
gccgtccttcctgccgacgtcggggtggccgttcagcagccgagactcaagtaagcctttcactcgttacgggggctcagctgccccagtgtgtccaggc

SEQ ID NO: 3252 - DNA, 50 bp, Artificial Sequence
  Description of Artificial Sequence: Synthetic oligonucleotide
cggggtggccgttcagcagccgagactcaagtaagcctttcactcgttac

SEQ ID NO: 3253 - DNA, 100 bp, Artificial Sequence
  Description of Artificial Sequence: Synthetic polynucleotide
ggtactttcatctatactttgtgatactttctttttattttttcttctagaatagcctaacatggcagaccagagacagcgctcactgtctacctctggg

SEQ ID NO: 3254 - DNA, 100 bp, Artificial Sequence
  Description of Artificial Sequence: Synthetic polynucleotide
aaaagccacagttgtgtcagctatgccaggaagacggcagcctaacaaagttaccatcctcaaaggattggctaaaagcaagcaactggattgaacaccc

SEQ ID NO: 3255 - DNA, 49 bp, Artificial Sequence
  Description of Artificial Sequence: Synthetic oligonucleotide
acggcagcctaacaaagttaccatcctcaaaggattggctaaaagcaag

SEQ ID NO: 3256 - DNA, 49 bp, Artificial Sequence; identical to SEQ ID NO: 3255
  Description of Artificial Sequence: Synthetic oligonucleotide

SEQ ID NO: 3257 - DNA, 100 bp, Artificial Sequence
  Description of Artificial Sequence: Synthetic polynucleotide
aaaagccacagttgtgtcagctatgccaggaagacggcagcctaacaaagaatgtgtgtaagaactgcagcggaaccttctgtgatgcctgttcaacaaa

SEQ ID NO: 3258 - DNA, 100 bp, Artificial Sequence
  Description of Artificial Sequence: Synthetic polynucleotide
ttcaactgacaagtagtttgaccagacttggaggaaggattccttcaaagttaccatcctcaaaggattggctaaaagcaagcaactggattgaacaccc

SEQ ID NO: 3259 - DNA, 100 bp, Artificial Sequence
  Description of Artificial Sequence: Synthetic polynucleotide
aaaagccacagttgtgtcagctatgccaggaagacggcagcctaacaaaggtaactgtgatgagaaacggacaggcttttcatagggatgtctacagcag

SEQ ID NO: 3260 - DNA, 100 bp, Artificial Sequence
  Description of Artificial Sequence: Synthetic polynucleotide
tgttataaaacctgaaaattctcttgtgctttctcttcttttgcttctagttaccatcctcaaaggattggctaaaagcaagcaactggattgaacaccc

SEQ ID NO: 3261 - DNA, 100 bp, Artificial Sequence
  Description of Artificial Sequence: Synthetic polynucleotide
catcagaaacacaggagctagtccagcaggtcttgagtttggcaacacaggactccaacatttgtgctgtgtttgctgtacaaggaggaaaagtgggaag

SEQ ID NO: 3262 - DNA, 50 bp, Artificial Sequence
  Description of Artificial Sequence: Synthetic oligonucleotide
gcaggtcttgagtttggcaacacaggactccaacatttgtgctgtgtttg

SEQ ID NO: 3263 - DNA, 50 bp, Artificial Sequence; identical to SEQ ID NO: 3262
  Description of Artificial Sequence: Synthetic oligonucleotide

SEQ ID NO: 3264 - DNA, 50 bp, Artificial Sequence; identical to SEQ ID NO: 3262
  Description of Artificial Sequence: Synthetic oligonucleotide

SEQ ID NO: 3265 - DNA, 50 bp, Artificial Sequence; identical to SEQ ID NO: 3262
  Description of Artificial Sequence: Synthetic oligonucleotide

SEQ ID NO: 3266 - DNA, 50 bp, Artificial Sequence; identical to SEQ ID NO: 3262
  Description of Artificial Sequence: Synthetic oligonucleotide

SEQ ID NO: 3267 - DNA, 50 bp, Artificial Sequence; identical to SEQ ID NO: 3262
  Description of Artificial Sequence: Synthetic oligonucleotide

SEQ ID NO: 3268 - DNA, 50 bp, Artificial Sequence; identical to SEQ ID NO: 3262
  Description of Artificial Sequence: Synthetic oligonucleotide

SEQ ID NO: 3269 - DNA, 100 bp, Artificial Sequence
  Description of Artificial Sequence: Synthetic polynucleotide
catcagaaacacaggagctagtccagcaggtcttgagtttggcaacacaggattctgataatcctgaccttcgagaccggggctatatttattggcgcct

SEQ ID NO: 3270 - DNA, 50 bp, Artificial Sequence
  Description of Artificial Sequence: Synthetic oligonucleotide
ccagcagctcttgagtttggcaacacaggattctgataatcctgaccttc

SEQ ID NO: 3271 - DNA, 50 bp, Artificial Sequence; identical to SEQ ID NO: 3270
  Description of Artificial Sequence: Synthetic oligonucleotide

SEQ ID NO: 3272 - DNA, 50 bp, Artificial Sequence; identical to SEQ ID NO: 3270
  Description of Artificial Sequence: Synthetic oligonucleotide

SEQ ID NO: 3273 - DNA, 100 bp, Artificial Sequence
  Description of Artificial Sequence: Synthetic polynucleotide
atacatcagatgatgctatgcagctctgaaggaagaacatgtattgccaggactccaacatttgtgctgtgtttgctgtacaaggaggaaaagtgggaag

SEQ ID NO: 3274 - DNA, 100 bp, Artificial Sequence
  Description of Artificial Sequence: Synthetic polynucleotide
catcagaaacacaggagctagtccagcaggtcttgagtttggcaacacaggtaagaaatctggaaaaagcaagatgttgatttgtcttgtttcaaattgt

SEQ ID NO: 3275 - DNA, 50 bp, Artificial Sequence
  Description of Artificial Sequence: Synthetic oligonucleotide
ggcaacacaggtaagaaatctggaaaaagcaagatgttgatttgtcttgt

SEQ ID NO: 3276 - DNA, 50 bp, Artificial Sequence; identical to SEQ ID NO: 3275
  Description of Artificial Sequence: Synthetic oligonucleotide

SEQ ID NO: 3277 - DNA, 50 bp, Artificial Sequence; identical to SEQ ID NO: 3275
  Description of Artificial Sequence: Synthetic oligonucleotide

SEQ ID NO: 3278 - DNA, 100 bp, Artificial Sequence
  Description of Artificial Sequence: Synthetic polynucleotide
ctcctgccagcctgaaaggtctaggataataccttcaacttcccttataggactccaacatttgtgctgtgtttgctgtacaaggaggaaaagtgggaag

What is claimed is:

1. A method for identifying a gene fusion in a biological sample obtained from a human subject, wherein the biological sample is a formalin-fixed paraffin embedded (FFPE) sample, comprising:
    obtaining a plurality of reads from RNA sequencing of the biological sample;
    mapping a read to the human genome;
    determining whether the read comprises a distant spliced junction;
    selecting the read comprising a distant spliced junction;
    identifying a candidate gene fusion comprising the distant spliced junction;
    creating a first set of templates for the candidate gene fusion, wherein the first set of templates comprises:
    (1) a fusion template comprising 50 base pairs (bp) of exonic sequence of a preserved region of a donor gene and 50 bp of exonic sequence of a preserved region of an acceptor gene,
    (2) a donor template comprising 50 bp of exonic sequence of a preserved region of a donor gene and 50 bp of exonic sequence of a discarded region of a donor gene, (3) an acceptor template comprising 50 bp of exonic sequence of a discarded region of an acceptor gene and 50 bp of exonic sequence of a preserved region of an acceptor gene,
(4) a donor genomic template comprising 50 bp upstream genomic sequence of a donor splicing site and 50 bp downstream genomic sequence of a donor splicing site, and
(5) an acceptor genomic template comprising 50 bp upstream genomic sequence of an acceptor splicing site and 50 bp downstream genomic sequence of an acceptor splicing site;

removing the candidate gene fusion if any of the first template set sequences are identical, but map to different genes in the human genome;

creating a second set of templates comprising:
(a) a fusion template comprising 150 bp of exonic sequence of a preserved region of a donor gene and 150 bp of exonic sequence of a preserved region of an acceptor gene,
(b) a donor template comprising 150 bp of exonic sequence of a preserved region of a donor gene and 150 bp of exonic sequence of a discarded region of a donor gene,
(c) an acceptor template comprising 150 bp of exonic sequence of a discarded region of an acceptor gene and 150 bp of exonic sequence of a preserved region of an acceptor gene,
(d) a donor genomic template comprising 150 bp upstream genomic sequence of a donor splicing site and 150 bp downstream genomic sequence of a donor splicing site, and
(e) an acceptor genomic template comprising 150 bp upstream genomic sequence of an acceptor splicing site and 150 bp downstream genomic sequence of an acceptor splicing site;

determining the homology between templates (b) and (c) and between templates (d) and (e);

removing the candidate gene fusion if templates (b) and (c) are homologous or if templates (d) and (e) are homologous; and aligning a read obtained from RNA sequencing of the biological sample to the first set of templates;

selecting the read that maps to the fusion template of the first set of templates; and identifying a gene fusion, wherein the gene fusion is identified by at least two non-duplicate reads that map to the fusion template of the first set of templates.

2. The method of claim 1, further comprising preparing a report based on the identification of a gene fusion.

3. The method of claim 1, wherein the read is a single end read.

4. The method of claim 1, wherein the read is a paired-end read.

5. The method of claim 1, wherein the read is at least 50 bases.

6. The method of claim 1, wherein human subject is a cancer patient, and the cancer is selected from breast cancer, colon cancer, lung cancer, prostate cancer, hepatocellular cancer, gastric cancer, pancreatic cancer, cervical cancer, ovarian cancer, liver cancer, bladder cancer, cancer of the urinary tract, thyroid cancer, renal cancer, carcinoma, melanoma, and brain cancer.

* * * * *